United States Patent 11,578,365 (CHICKEN WHOLE-GENOME SNP CHIP AND USE THEREOF) - sequence listing, part 3

SEQ ID NO: 38945 - DNA, 71 bp, chicken (Gallus Gallus)
  misc_feature (36): n=c or t
tatctaactgggaaccttgatctcccaagcaggaangcactcactcagtgaagttcttgctttaaaaaaat

SEQ ID NO: 38946 - DNA, 71 bp, chicken (Gallus Gallus)
  misc_feature (36): n=c or t
agaacatattttaagatttgcaatgtctgaaattanggtaagaataaattcagaaagcctgctatttttgc

SEQ ID NO: 38947 - DNA, 71 bp, chicken (Gallus Gallus)
  misc_feature (36): n=a or g
ttttcaatagtggtttgacttcattcaaaatattcnaattctagtaatgtgcaatttccattccataggaa

SEQ ID NO: 38948 - DNA, 71 bp, chicken (Gallus Gallus)
  misc_feature (36): n=c or t
aactttcccaaaagagtgaagggctatgccaaccancaaagaattcaaggagctggaatcagagagcatta

SEQ ID NO: 38949 - DNA, 71 bp, chicken (Gallus Gallus)
  misc_feature (36): n=a or c
acacgaggacagaagcctgaaactatcagctcaaantcagttgagtgtcattagatcagcactgccatgag

SEQ ID NO: 38950 - DNA, 71 bp, chicken (Gallus Gallus)
  misc_feature (36): n=a or g
atagtttcacttcatgtgtagtgcttttgtttctgnatctgggaactgaatacgggcaattccttttaccc

SEQ ID NO: 38951 - DNA, 71 bp, chicken (Gallus Gallus)
  misc_feature (36): n=a or g
atttgtgcgtgagggtgatggactgaatttggatcntgctagtgagacttgaggacttcagttgatgttgt

SEQ ID NO: 38952 - DNA, 71 bp, chicken (Gallus Gallus)
  misc_feature (36): n=a or g
cttaatccttgctaactaggtgtagaaatataaagnaaagtagaagctacataccaaatcaagctcgctaa

SEQ ID NO: 38953 - DNA, 71 bp, chicken (Gallus Gallus)
  misc_feature (36): n=a or g
actcgaagtcttcagtgttttacttgagagtactgnaaggacagcctttctgagtttatagaagttgctat

SEQ ID NO: 38954 - DNA, 71 bp, chicken (Gallus Gallus)
  misc_feature (36): n=c or t
aagaagcataattctaaatttgctctgatgcttcantgatgctaatgtatgttctattaacttcgctggat

SEQ ID NO: 38955 - DNA, 71 bp, chicken (Gallus Gallus)
  misc_feature (36): n=a or g
cacagacacatatatgcatgtataaacacacatacnttgtaggcatttttgcccatattctgttactggtc

SEQ ID NO: 38956 - DNA, 71 bp, chicken (Gallus Gallus)
  misc_feature (36): n=g or t
tttgacattaagcccaaattaaatatcagaaagatnaaactattgatgtagattatcttaaccagacagac

SEQ ID NO: 38957 - DNA, 71 bp, chicken (Gallus Gallus)
  misc_feature (36): n=a or g
gttcagatgctgtacatataatgagaaagccctatngttctcactgagcataaaattccagtagctcttca

SEQ ID NO: 38958 - DNA, 71 bp, chicken (Gallus Gallus)
  misc_feature (36): n=a or g
ttcaaattaaaaatattaaggtggctccaagcaagnagaaaagaacctgctttctcatactatgtgtacag

SEQ ID NO: 38959 - DNA, 71 bp, chicken (Gallus Gallus)
  misc_feature (36): n=a or g
ctgaggcatctattttatgctgtacaaagtcagttnccacaaacgtgaatccatatgacaacccctaccct

SEQ ID NO: 38960 - DNA, 71 bp, chicken (Gallus Gallus)
  misc_feature (36): n=a or c
tactttcaacaatctgtagtagttcaagatgcaaanctcatacattcccagcctataagaacacgctggca

SEQ ID NO: 38961 - DNA, 71 bp, chicken (Gallus Gallus)
  misc_feature (36): n=c or t
accctgttcactaacaccccagtgtgcttaaatctncaatatagatattttggtttacatttcaaaagaaa

SEQ ID NO: 38962 - DNA, 71 bp, chicken (Gallus Gallus)
  misc_feature (36): n=c or t
ggttctgatcgagaccattgttggcgcaatgatccngtgcatgtcagcatggtggtaaaccacatggtaag

SEQ ID NO: 38963 - DNA, 71 bp, chicken (Gallus Gallus)
  misc_feature (36): n=a or g
aagtaaaggcattactacttataatgacttatgaanacttttttccttacagtgatgaggtgtttgggaat

SEQ ID NO: 38964 - DNA, 71 bp, chicken (Gallus Gallus)
  misc_feature (36): n=a or g
gaatttgatttttgcttctcagatataaagttcccntgaaattgtgtgtgaactacaacacatgtatgagt

SEQ ID NO: 38965 - DNA, 71 bp, chicken (Gallus Gallus)
  misc_feature (36): n=a or g
cttttcaagcaaggtatgtttttcttaactctatgnaccacctatggctgaatgtagcttcttcagaagag

SEQ ID NO: 38966 - DNA, 71 bp, chicken (Gallus Gallus)
  misc_feature (36): n=a or g
aaacttatgagtgaataatattgtacgctttatggnatacagagatgtttttcttgtttttctgttgttca

SEQ ID NO: 38967 - DNA, 71 bp, chicken (Gallus Gallus)
  misc_feature (36): n=a or g
aaactgtcgtgtctgcatctccttctgtcccgtganagtctctgggaaagctggtgccattagtttcatta

SEQ ID NO: 38968 - DNA, 71 bp, chicken (Gallus Gallus)
  misc_feature (36): n=a or g
attcatatcacttttcttctgttattccagtctgcngcttctctgaaaacctgctgctactattcattttt

SEQ ID NO: 38969 - DNA, 71 bp, chicken (Gallus Gallus)
  misc_feature (36): n=a or g
tgaagtgcaccattaaaaatttttgtggatgactancataattccttttattacaatagtatttgtattat

SEQ ID NO: 38970 - DNA, 71 bp, chicken (Gallus Gallus)
  misc_feature (36): n=c or t
tcatcagtttgaggcgcaaagaggaagaaaaagtgnctgaaaatgagagcatcattaatttgcactgtcag

SEQ ID NO: 38971 - DNA, 71 bp, chicken (Gallus Gallus)
  misc_feature (36): n=c or t
tgcaatgctaggagaagtcacagatataaaattttnctatatacccttcttatttcactgagctatttgaa

SEQ ID NO: 38972 - DNA, 71 bp, chicken (Gallus Gallus)
  misc_feature (36): n=g or t
gaataagcttcagcgtctgccttctatttccagganttacactctagaatcagaacaaacaaattttattt

SEQ ID NO: 38973 - DNA, 71 bp, chicken (Gallus Gallus)
  misc_feature (36): n=a or g
ctttccttgaaggcttgtgctgcagctgtagtttangaaaccactatcgttcctgctgtatgtatgtccta

SEQ ID NO: 38974 - DNA, 71 bp, chicken (Gallus Gallus)
  misc_feature (36): n=a or g
ttctatatgtgaaaaaaaattgtcactggctctagntaaagggaatttgaaaattttatattcccactatc

SEQ ID NO: 38975 - DNA, 71 bp, chicken (Gallus Gallus)
  misc_feature (36): n=c or t
tccacatgtactgacaaattttactttctgttattntgtcttcaaggttatccaaatgttatggtgttaaa

SEQ ID NO: 38976 - DNA, 71 bp, chicken (Gallus Gallus)
  misc_feature (36): n=c or t
ttttagtattctggcttccagtctccaactgtcttnggttaatgaacaagactgcatggatttatatgtac

SEQ ID NO: 38977 - DNA, 71 bp, chicken (Gallus Gallus)
  misc_feature (36): n=a or g
aaaaaaaaaaaagtgctgaaatcttgcagaattgtntaccgtaggataaaatattgagaatattgaattaa

SEQ ID NO: 38978 - DNA, 71 bp, chicken (Gallus Gallus)
  misc_feature (36): n=a or g
caccaccacaacaaaactccatcagctcataacatnttattgttcaggctcactattttacaaataaaagg

SEQ ID NO: 38979 - DNA, 71 bp, chicken (Gallus Gallus)
  misc_feature (36): n=c or t
tttattacctccagccttttgttaggctgttgcaangatgtaaaaacaatttgtccgtttttctttcagct

SEQ ID NO: 38980 - DNA, 71 bp, chicken (Gallus Gallus)
  misc_feature (36): n=a or c
catgctacttgagcattgccttctccttctcctgantgccagaaaagctggtcctctgcctggctactgat

SEQ ID NO: 38981 - DNA, 71 bp, chicken (Gallus Gallus)
  misc_feature (36): n=a or g
ttacagaggaagttaatgaggatggagcagtgtcantaagactgcatgggacaaagctgggaacatcataa

SEQ ID NO: 38982 - DNA, 71 bp, chicken (Gallus Gallus)
  misc_feature (36): n=a or g
accacactagttgccagggctcagcttcatcaaagnaatcatcatcataaagttcatcttatcaagataag

SEQ ID NO: 38983 - DNA, 71 bp, chicken (Gallus Gallus)
  misc_feature (36): n=c or t
ccatgagctcccatttgttaatctgaattaatgagnagatgatctccagttaagtttgaaaaaaataataa

SEQ ID NO: 38984 - DNA, 71 bp, chicken (Gallus Gallus)
  misc_feature (36): n=a or c
tggtttctaagtaggggaaaaggagatccacagaanaagattctaatccttcaagtatgcatgtgcacaaa

SEQ ID NO: 38985 - DNA, 71 bp, chicken (Gallus Gallus)
  misc_feature (36): n=c or t
ttctacgcagtaaacccaagcctggcaatgattacnaacattacgatccaagataagaccctgaggaaagt

SEQ ID NO: 38986 - DNA, 71 bp, chicken (Gallus Gallus)
  misc_feature (36): n=a or c
tctgtgcctttgatccatttaaaatgttctgcaaantgaataggtggagaagtcttgtaaccaccaccaac

SEQ ID NO: 38987 - DNA, 71 bp, chicken (Gallus Gallus)
  misc_feature (36): n=a or g
taacctggatgggtttctttgtctttctgtgcttgntgacactaagctctccttatctccatcccttcagg

SEQ ID NO: 38988 - DNA, 71 bp, chicken (Gallus Gallus)
  misc_feature (36): n=a or g
gatgaaagagcagcagagacatagtgttatgaactnatagcaaacagccaaggccaacccaggtagcccaa

SEQ ID NO: 38989 - DNA, 71 bp, chicken (Gallus Gallus)
  misc_feature (36): n=c or t
aggcacattgtgaatcaggtgtgagggaactggatncaggcaatggtgctggaacaacaaagtactcagtg

SEQ ID NO: 38990 - DNA, 71 bp, chicken (Gallus Gallus)
  misc_feature (36): n=c or t
aaaagttgtatcaaccacaagggtttttttctgttngtgtatgtgcatctctgctgtactgtttttccagt

SEQ ID NO: 38991 - DNA, 71 bp, chicken (Gallus Gallus)
  misc_feature (36): n=a or g
agaatgccattgtaaaattgtgtctatgtgcgtctntgtgtgtctatctcaatgcggtagagacaccaaat

SEQ ID NO: 38992 - DNA, 71 bp, chicken (Gallus Gallus)
  misc_feature (36): n=c or t
gaccattgctttctctggaaagaatgcagtgtgagngtacagtttaaaaataggtatataatttttaatac

SEQ ID NO: 38993 - DNA, 71 bp, chicken (Gallus Gallus)
  misc_feature (36): n=a or c
tccaggtgtgggatgctatcgaaggcactctgcgcngcagtaacgatgaaagtcagtctggcatcacagcc

SEQ ID NO: 38994 - DNA, 71 bp, chicken (Gallus Gallus)
  misc_feature (36): n=c or t
aatcctcaaggttcaatgctgtatacttcactttcntttcttatacatatgctgcacatatgccttgaact

SEQ ID NO: 38995 - DNA, 71 bp, chicken (Gallus Gallus)
  misc_feature (36): n=c or t
atgcccaaattctacctaatgttcccttcaactccncactgagttagcaaagtcagagggttgtatcaaaa

SEQ ID NO: 38996 - DNA, 71 bp, chicken (Gallus Gallus)
  misc_feature (36): n=c or t
atgtgacatgcacatacaaactgtcctgggtttccnctggaggattatatttgaaggctgtgaaatcttca

SEQ ID NO: 38997 - DNA, 71 bp, chicken (Gallus Gallus)
  misc_feature (36): n=a or g
gggcttagcaagcaagttttagaagcaagtcctgtnctgggagattcaactttatacatatacttgttctt

SEQ ID NO: 38998 - DNA, 71 bp, chicken (Gallus Gallus)
  misc_feature (36): n=g or t
taaatatttatcattagctagaagtggaggaatttntctgaaaataacacaggtctggaaaaggtaaaaat

SEQ ID NO: 38999 - DNA, 71 bp, chicken (Gallus Gallus)
  misc_feature (36): n=c or t
gttatttatgacaccctttgtactttgacagtatcncagaaagtcgcctaacggattgccttagctgtctg

SEQ ID NO: 39000 - DNA, 71 bp, chicken (Gallus Gallus)
  misc_feature (36): n=a or g
aaatgcttatggatcatcattgcttggccaaagacngctaatttattcatatggatgcttataaatagttt

SEQ ID NO: 39001 - DNA, 71 bp, chicken (Gallus Gallus)
  misc_feature (36): n=a or g
gaaacatgctgcatgaggaagcatccagattataantgctgttttaggcctaaaattatacatatggcact

SEQ ID NO: 39002 - DNA, 71 bp, chicken (Gallus Gallus)
  misc_feature (36): n=c or t
cagtatttctgggagatggaggaaagggagattctnttccgttttactgcacatccagcaaatagggtgac

SEQ ID NO: 39003 - DNA, 71 bp, chicken (Gallus Gallus)
  misc_feature (36): n=c or t
attagagtatgtaactggagcaagagaaatgtcctnccttttctgggatcacacttattctgcctgccaag

SEQ ID NO: 39004 - DNA, 71 bp, chicken (Gallus Gallus)
  misc_feature (36): n=g or t
ctccatcattcatcccaatttgccagcatgcataanagcagtggtttctgggtgcctacaatctctccatt

SEQ ID NO: 39005 - DNA, 71 bp, chicken (Gallus Gallus)
  misc_feature (36): n=c or t
ctatttcacctgttagtcatcacccctgtactccanggtcatgctcagaatgatctaaaaattaaatggga

SEQ ID NO: 39006 - DNA, 71 bp, chicken (Gallus Gallus)
  misc_feature (36): n=c or t
tcgtgacctttcaagctcttctacttcctctcttgntctttatgaattggtcattatttaccagatattta

SEQ ID NO: 39007 - DNA, 71 bp, chicken (Gallus Gallus)
  misc_feature (36): n=c or t
gaggtggaatgacatcaagctactctggacactcgntgcattagactttgttacctgcaaactacgattct

SEQ ID NO: 39008 - DNA, 71 bp, chicken (Gallus Gallus)
  misc_feature (36): n=a or g
aacaagaccagaaagggagaaaatagctgcatcagnttttgttaggccgcttctctacagccctgagaagg

SEQ ID NO: 39009 - DNA, 71 bp, chicken (Gallus Gallus)
  misc_feature (36): n=a or g
attagcaaaggatcacagaaggctgagttttgaagnctgagataacaactgaatgaaccctcagaatttgc

SEQ ID NO: 39010 - DNA, 71 bp, chicken (Gallus Gallus)
  misc_feature (36): n=a or c
ctaatttaggcgggtgtgtgcccacatgccatcccnttggagactggtattttcatacttcatacaaacgg

SEQ ID NO: 39011 - DNA, 71 bp, chicken (Gallus Gallus)
  misc_feature (36): n=a or g
tgagaaatgtaactaaaacttctgctcaatgcaacncataaggcaactgcacactctcttcatggcagaca

SEQ ID NO: 39012 - DNA, 71 bp, chicken (Gallus Gallus)
  misc_feature (36): n=c or t
ctttacaaattactcctaaaaccagagttctaaaangagcacaagggactacatttgcacaatttgatgtt

SEQ ID NO: 39013 - DNA, 71 bp, chicken (Gallus Gallus)
  misc_feature (36): n=a or g
tctggaacataaaatgatttcaggaccttcttgccntgtttaagttatttttataataatagatctacctc

SEQ ID NO: 39014 - DNA, 71 bp, chicken (Gallus Gallus)
  misc_feature (36): n=a or g
ttttgccttttagaggagatttccacagtggttttntgtctgtatttctgacattctgacatctgacagta

SEQ ID NO: 39015 - DNA, 71 bp, chicken (Gallus Gallus)
  misc_feature (36): n=a or g
taaacatgactctactgtctttctagctgtctgacntcttcacaatagggtgatgaactaagaagccaggt

SEQ ID NO: 39016 - DNA, 71 bp, chicken (Gallus Gallus)
  misc_feature (36): n=a or c
acaggtaagctccacagtttacagattttgtctttntttagccttaggtaacagtggtagcagattgttca

SEQ ID NO: 39017 - DNA, 71 bp, chicken (Gallus Gallus)
  misc_feature (36): n=g or t
caagggaaggtaatattttacatcaatcatgaactnatgtttttatatccaaaagggatcactcgtggggg

SEQ ID NO: 39018 - DNA, 71 bp, chicken (Gallus Gallus)
  misc_feature (36): n=a or g
aagaaaggacagttattttactggcacctgaggccncagttcaacacagtatctagaagtagaaaacatgt

SEQ ID NO: 39019 - DNA, 71 bp, chicken (Gallus Gallus)
  misc_feature (36): n=a or g
gcgcgtgagcagggacatggtgggaaggttggtagnatgggaacagtttccttctcaggggcccctctgct

SEQ ID NO: 39020 - DNA, 71 bp, chicken (Gallus Gallus)
  misc_feature (36): n=c or t
aaggcagccttcatatacagtttatctctagtagcngttaacagattgaatcaaaggacttttcatattct

SEQ ID NO: 39021 - DNA, 71 bp, chicken (Gallus Gallus)
  misc_feature (36): n=g or t
aagcacagggaaagtggcctcagaaaaactgtgacntttggtatggttccttcacgccaccttcttaatta

SEQ ID NO: 39022 - DNA, 71 bp, chicken (Gallus Gallus)
  misc_feature (36): n=a or g
ctggcttaaatctcagctcatggcaagacagcatcnagggaggactgtgtttgtgcatctctctctcttct

SEQ ID NO: 39023 - DNA, 71 bp, chicken (Gallus Gallus)
  misc_feature (36): n=a or g
ggatcactggaagcatatgaagttcattttaagatngagcagtaacttatattagaggatgtaaaaggtct

SEQ ID NO: 39024 - DNA, 71 bp, chicken (Gallus Gallus)
  misc_feature (36): n=a or g
tgaaaattttccagtgtttcggtacttttcagctgntatctcttctgcaattggttaagtgaaaaccaggt

SEQ ID NO: 39025 - DNA, 71 bp, chicken (Gallus Gallus)
  misc_feature (36): n=a or g
acatcacaggtccaggacagatatgcagcccatggncctggcatttcatctacttgcctgctgcactgtca

SEQ ID NO: 39026 - DNA, 71 bp, chicken (Gallus Gallus)
  misc_feature (36): n=c or t
ggcattctcctgaagggatgcttccgtttgattggngtgcttgtgctctaacacacacaagcaccgtcagt

SEQ ID NO: 39027 - DNA, 71 bp, chicken (Gallus Gallus)
  misc_feature (36): n=g or t
ttcactactgttgaagtctctttgtctttggatttntctcttctttcaggttccttttccttgtctttagt

SEQ ID NO: 39028 - DNA, 71 bp, chicken (Gallus Gallus)
  misc_feature (36): n=c or t
tggaacacaaaccagaaatacctatgtcttggcaancctgtggatctgtaaaaaaagctgaagtattgcat

SEQ ID NO: 39029 - DNA, 71 bp, chicken (Gallus Gallus)
  misc_feature (36): n=c or t
ggaacaaccacattgtttggacatattccacttgcncatgttatcttatagtaagccattactgcagcctt

SEQ ID NO: 39030 - DNA, 71 bp, chicken (Gallus Gallus)
  misc_feature (36): n=a or c
tccttggggtgatggatcagatactgttctccccanctcagctctgtgcttggaaaactaagcttgaaggc

SEQ ID NO: 39031 - DNA, 71 bp, chicken (Gallus Gallus)
  misc_feature (36): n=c or t
ctctgtgcgtcagagcgagtctccagacagtgctgngatgttcagtaaatcctcctaaatgcatcaccctc

SEQ ID NO: 39032 - DNA, 71 bp, chicken (Gallus Gallus)
  misc_feature (36): n=a or g
ggaagaaactctgtggaggaacagaagtcacctacntttactttctgagccctctaagttccttctccact

SEQ ID NO: 39033 - DNA, 71 bp, chicken (Gallus Gallus)
  misc_feature (36): n=a or g
cgtttacttccagggctggactgcacattttggggntgtatttgaagtttacaggtgcataagtgaagatg

SEQ ID NO: 39034 - DNA, 71 bp, chicken (Gallus Gallus)
  misc_feature (36): n=c or t
gtggtttcaattagcagaagactggagaagtgcttncatagacttccttagcaagggaaaggaaagtttgg

SEQ ID NO: 39035 - DNA, 71 bp, chicken (Gallus Gallus)
  misc_feature (36): n=a or g
tcgtaaattagtcatacactccctggtgggggaacngtttcatacatgcttgtgtggctctcagcataata

SEQ ID NO: 39036 - DNA, 71 bp, chicken (Gallus Gallus)
  misc_feature (36): n=c or t
tgaagctcttcttttacctactttaccttaaacacngcaaatgttacacagctgagatcaataattggaac

SEQ ID NO: 39037 - DNA, 71 bp, chicken (Gallus Gallus)
  misc_feature (36): n=c or t
gactccttcaccaactacaatctgcaatttcctgcntcattaacagaaactagacatcactccgaaaatac

SEQ ID NO: 39038 - DNA, 71 bp, chicken (Gallus Gallus)
  misc_feature (36): n=g or t
agctgatacaaactccacctgaataggaccatgtcngtgtactccgttttctggccagtactgaggacaca

SEQ ID NO: 39039 - DNA, 71 bp, chicken (Gallus Gallus)
  misc_feature (36): n=c or t
cctcctagaagtgcctttgtttttgttcactatganaagagtttagacacctgctttagactaggtgtttg

SEQ ID NO: 39040 - DNA, 71 bp, chicken (Gallus Gallus)
  misc_feature (36): n=a or c
tgcagagaagcaagtaaaaccagtctagttaacacnttttacatatgctccagctcattatgatattcaca

SEQ ID NO: 39041 - DNA, 71 bp, chicken (Gallus Gallus)
  misc_feature (36): n=a or g
atggaacttgcactcctcctttgcaagtaaaacctntaggtaggaattcagatactgtttctctttattcg

SEQ ID NO: 39042 - DNA, 71 bp, chicken (Gallus Gallus)
  misc_feature (36): n=a or g
tgaggtttcaatcctgttgcaagaatctcttgacanaagtaaattctagtatttacaaccatggacacatc

SEQ ID NO: 39043 - DNA, 71 bp, chicken (Gallus Gallus)
  misc_feature (36): n=a or g
tgttaaagcattataagaaaccatggagagccccancaagcacctctccaaagatgttatctttgggaagg

SEQ ID NO: 39044 - DNA, 71 bp, chicken (Gallus Gallus)
  misc_feature (36): n=g or t
ccagcttctctttatttgtgacagttctcctctttnactcactgcactgcaacttcacgaagctgcacagc

SEQ ID NO: 39045 - DNA, 71 bp, chicken (Gallus Gallus)
  misc_feature (36): n=c or t
gtccattcagtgcacagccatttcaaactagccagngaagaaaaaccaaatgtagatacaacttcttcaac

SEQ ID NO: 39046 - DNA, 71 bp, chicken (Gallus Gallus)
  misc_feature (36): n=a or g
tggcacaaacaagcagacaactgtacttgtacatcnacatgaggtgcttaggaaaggggaaggaagagggg

SEQ ID NO: 39047 - DNA, 71 bp, chicken (Gallus Gallus)
  misc_feature (36): n=a or g
agattctgagccttgtgctcctgttcactcctgacncagccagaatcagcagattaagcctctcagctcat

SEQ ID NO: 39048 - DNA, 71 bp, chicken (Gallus Gallus)
  misc_feature (36): n=c or t
catatcagtgtaatgaattacgctgtttattacttntaaaataaatgactattattaatacacacatcatc

SEQ ID NO: 39049 - DNA, 71 bp, chicken (Gallus Gallus)
  misc_feature (36): n=a or g
gcagctatctgcgaaccacaacttattctgctgggnaataagtgaagttggaatacttgaatacaggaagt

SEQ ID NO: 39050 - DNA, 71 bp, chicken (Gallus Gallus)
  misc_feature (36): n=c or t
tgtgccccataacaccctccacagccccactgaggngcgtggatcgcagcatcccccactcagtgccttgg

SEQ ID NO: 39051 - DNA, 71 bp, chicken (Gallus Gallus)
  misc_feature (36): n=c or t
tgacccccatctttttcacagggaaatggaaactcnatgcctgtatgcattactatctaatgttagtttac

SEQ ID NO: 39052 - DNA, 71 bp, chicken (Gallus Gallus)
  misc_feature (36): n=a or g
caattttgcccatgtgagaactgcaggatcaggctntagagtccccgtagcattttggcatttggtgagca

SEQ ID NO: 39053 - DNA, 71 bp, chicken (Gallus Gallus)
  misc_feature (36): n=c or t
gagagtatttcatatgcatttgactacctcccattnccttgctagctttcatttaacagttataacctcag

SEQ ID NO: 39054 - DNA, 71 bp, chicken (Gallus Gallus)
  misc_feature (36): n=a or g
tggtgaaattcctcagtagccagaatctcccgggcncttctccattgatttttctctggataaaacttcag

SEQ ID NO: 39055 - DNA, 71 bp, chicken (Gallus Gallus)
  misc_feature (36): n=g or t
ctggctgtgtctgcaaacaccagcgctatggtgggnttaagccactttgaggatttcagtcaaaagctgct

SEQ ID NO: 39056 - DNA, 71 bp, chicken (Gallus Gallus)
  misc_feature (36): n=a or g
gcaaacactgtatcacaccttgatgtgtctataaanaaggcattcaattagctatatatgagttgattttt

SEQ ID NO: 39057 - DNA, 71 bp, chicken (Gallus Gallus)
  misc_feature (36): n=c or t
aaaacaagcattaaatataaacagcaaccatattcntaagaaactagtatagcattacagtaaaatacttg

SEQ ID NO: 39058 - DNA, 71 bp, chicken (Gallus Gallus)
  misc_feature (36): n=a or g
atctacatttgttaaatatgacttcatgtatttaantcccaggcccaacttaactataccccatactttgc

SEQ ID NO: 39059 - DNA, 71 bp, chicken (Gallus Gallus)
  misc_feature (36): n=g or t
aaaactcctgatcgtggcatacactgtctgtgtganattgtaacaactgctggactataatctttgtactc

SEQ ID NO: 39060 - DNA, 71 bp, chicken (Gallus Gallus)
  misc_feature (36): n=c or t
ggtagaataagaaacagaattcaatttagagggctngtataacacaaagtggcaaattcaatatgtttgga

SEQ ID NO: 39061 - DNA, 71 bp, chicken (Gallus Gallus)
  misc_feature (36): n=a or g
tagtcttctagtgattctctttgtagtcactgtttntctggcttgcttactgtagctcaactggtgcaaga

SEQ ID NO: 39062 - DNA, 71 bp, chicken (Gallus Gallus)
  misc_feature (36): n=g or t
cactgtctgagccctgaaatggtacaggaaaagaantaataaacatatgcttttcagtagggaaaaaaaca

SEQ ID NO: 39063 - DNA, 71 bp, chicken (Gallus Gallus)
  misc_feature (36): n=a or g
cattgagttgtcaagattagacctgttcttttgcanaaggagaatcctatttgcttatgctgaaccggtca

SEQ ID NO: 39064 - DNA, 71 bp, chicken (Gallus Gallus)
  misc_feature (36): n=a or c
agtttgtgctgcaaggatctgacatttatgggactnatttagatgaatatgtttcctagctcactaaaatc

SEQ ID NO: 39065 - DNA, 71 bp, chicken (Gallus Gallus)
  misc_feature (36): n=a or g
tttttttttcttccagaccacttaaaagcagtaccnaccaacagaattattggcagtgggttcattaaaaa

SEQ ID NO: 39066 - DNA, 71 bp, chicken (Gallus Gallus)
  misc_feature (36): n=a or c
actctcctctgtcttaccgggttcactgaagctgtnttcacagaagaaacagtttactactgagtgtagca

SEQ ID NO: 39067 - DNA, 71 bp, chicken (Gallus Gallus)
  misc_feature (36): n=a or g
tgagataggaaagctagaaacattagcatgacttgntttatagaaatggacagtgatgcattaaaatacat

SEQ ID NO: 39068 - DNA, 71 bp, chicken (Gallus Gallus)
  misc_feature (36): n=c or t
cattcagggagaactgaaaacagaatacatcagaanggacatcataggtatttgtactcttacatgtggga

SEQ ID NO: 39069 - DNA, 71 bp, chicken (Gallus Gallus)
  misc_feature (36): n=a or g
acaaagcagccccaaccaatggcacagggtgaggcnacagagcagagcaaggtcaccgagtgaggctgctg

SEQ ID NO: 39070 - DNA, 71 bp, chicken (Gallus Gallus)
  misc_feature (36): n=a or g
cacggggagcaaagggctcagctgtatcagcccccngtgccgggtgcctcctagcaacgcagggcacacag

SEQ ID NO: 39071 - DNA, 71 bp, chicken (Gallus Gallus)
  misc_feature (36): n=c or t
gctcgcagtgctctccctccaaagggatgtcttttnagctgaacagaaatgcatggagcagagggtttcct

SEQ ID NO: 39072 - DNA, 71 bp, chicken (Gallus Gallus)
  misc_feature (36): n=a or g
ttttgctgtggggaaaagagcagcaattttcctccnaaggtagcagtgagggaggggcagtgagtgctgta

SEQ ID NO: 39073 - DNA, 71 bp, chicken (Gallus Gallus)
  misc_feature (36): n=a or g
ttttttttcttttttttattttccaggcaggaaacnctttggaaaggaatcatgcaaaaagtgatgttctg

SEQ ID NO: 39074 - DNA, 71 bp, chicken (Gallus Gallus)
  misc_feature (36): n=a or g
aaaggaaaatttcaggataactttgaatttgttcantggttcaaaaaattttttgatgcaaactacgatgg

SEQ ID NO: 39075 - DNA, 71 bp, chicken (Gallus Gallus)
  misc_feature (36): n=a or c
ccccggatttcccaaatctgagaattccacacctgnatggtggcacaaagtggaggagcattgctcgtcac

SEQ ID NO: 39076 - DNA, 71 bp, chicken (Gallus Gallus)
  misc_feature (36): n=c or t
ggagccgtgcgctgattggaatcaccgagcaggaangcttcgagtccccgcgtggcacccacatgcacggc

SEQ ID NO: 39077 - DNA, 71 bp, chicken (Gallus Gallus)
  misc_feature (36): n=c or t
atttaaaacacctcgtttcccccagtttggttgccngagagcagcaatctgtagtaattggctcaacagtg

SEQ ID NO: 39078 - DNA, 71 bp, chicken (Gallus Gallus)
  misc_feature (36): n=a or g
cccccatgctgacctccccccacctgcccccgcacncagggcgtgtgccatctcattagtgtgtctgtccc

SEQ ID NO: 39079 - DNA, 71 bp, chicken (Gallus Gallus)
  misc_feature (36): n=g or t
cctcgtcgtcctcggacgtcaggtggctcttgtggngtcgcttcagcgtgaggatcagaagcaccagcact

SEQ ID NO: 39080 - DNA, 71 bp, chicken (Gallus Gallus)
  misc_feature (36): n=a or g
gggcgcaccccatgggcaccgtgagctcccagcacngcctccccggtgggcatccatgtctcccagctgtg

SEQ ID NO: 39081 - DNA, 71 bp, chicken (Gallus Gallus)
  misc_feature (36): n=c or t
tgtccggtgagctttctttgttcctcagtttcatcngtaattcagtctgtcacaaaccctttttaatacag

SEQ ID NO: 39082 - DNA, 71 bp, chicken (Gallus Gallus)
  misc_feature (36): n=a or g
caaaacagtgcctccatcttttcagataagcagcantggatcagtttagaatgaaatcccaaaaaaggcac

SEQ ID NO: 39083 - DNA, 71 bp, chicken (Gallus Gallus)
  misc_feature (36): n=a or g
agtggtacgcttcaatggctatgctagttgccagcngatctatcaatgttggccaccttgggcatggggaa

SEQ ID NO: 39084 - DNA, 71 bp, chicken (Gallus Gallus)
  misc_feature (36): n=c or t
aggcatgttattaattacagatatttccctaactcnacttctctgactattgtccagcagttcacgtctgc

SEQ ID NO: 39085 - DNA, 71 bp, chicken (Gallus Gallus)
  misc_feature (36): n=c or t
tcccagctcattggcaccagcagaacgaagacgtangtccaggagcactccatcgttgacccactgaaaaa

SEQ ID NO: 39086 - DNA, 71 bp, chicken (Gallus Gallus)
  misc_feature (36): n=a or g
cacatactgcaaaggaagccagtgcatttagcactncatatcctgtgtcatcactagaaactaagagtttt

SEQ ID NO: 39087 - DNA, 71 bp, chicken (Gallus Gallus)
  misc_feature (36): n=a or g
ttgagccttgatcaaatcagctacactgaacctggncacaatgcactctacaccgtcagctctgacttctt

SEQ ID NO: 39088 - DNA, 71 bp, chicken (Gallus Gallus)
  misc_feature (36): n=a or g
gttgtaaggaagctttaagcaaacttcaggtcatgntatgtaccttgatgtgcacttacatacccaacagg

SEQ ID NO: 39089 - DNA, 71 bp, chicken (Gallus Gallus)
  misc_feature (36): n=a or g
agcactgaataactcagttatgaatctgattcaagnaactacaatcaactcagtcctcaaaacagacctga

SEQ ID NO: 39090 - DNA, 71 bp, chicken (Gallus Gallus)
  misc_feature (36): n=c or t
atatgctttactgacttgcaatattatacttattanatagtgcatttaaggaaattctgatatttgctctg

SEQ ID NO: 39091 - DNA, 71 bp, chicken (Gallus Gallus)
  misc_feature (36): n=a or g
ccgtcccagctctcatgccactagaagggagaacanaaattaatgttgggctgctgggaatgtgaaggaag

SEQ ID NO: 39092 - DNA, 71 bp, chicken (Gallus Gallus)
  misc_feature (36): n=c or t
gatgttatgtgttatttttgacaaagtaataaaatngctgcactcactgagacctcactccagggctccaa

SEQ ID NO: 39093 - DNA, 71 bp, chicken (Gallus Gallus)
  misc_feature (36): n=a or g
aacatgcatttctgattaacagaaggagcagatcgngatgaacaccacttggaaactctgaagggcattaa

SEQ ID NO: 39094 - DNA, 71 bp, chicken (Gallus Gallus)
  misc_feature (36): n=g or t
gatttcctacagctgcttagaaaaccaggcatctcngagtgctgcatagatcattagtacagcatttagtt

SEQ ID NO: 39095 - DNA, 71 bp, chicken (Gallus Gallus)
  misc_feature (36): n=c or t
tatgttagtgggccattgacttcataatttttcttnagtttgtttgtcattttagagtccttatttattat

SEQ ID NO: 39096 - DNA, 71 bp, chicken (Gallus Gallus)
  misc_feature (36): n=a or g
ttaaggtaaagggatgcaagtgtgctagcacttctngaatccactctgatgtgcgttggtgccaggtgagg

SEQ ID NO: 39097 - DNA, 71 bp, chicken (Gallus Gallus)
  misc_feature (36): n=a or c
gcaaagtcaccacctgaactagattcccttcactgncaatagagagaaataggatgcatgtggcctattta

SEQ ID NO: 39098 - DNA, 71 bp, chicken (Gallus Gallus)
  misc_feature (36): n=a or g
tggagagcagagtctggatggatgtgttccactccnaagtccctcctgctgcctgggacattaaatgctgg

SEQ ID NO: 39099 - DNA, 71 bp, chicken (Gallus Gallus)
  misc_feature (36): n=c or t
acaaccccgaattccccaaacacgtgtcagttcagngggaatgtctggaagaagaaaaaggtctgctgtaa

SEQ ID NO: 39100 - DNA, 71 bp, chicken (Gallus Gallus)
  misc_feature (36): n=c or t
tacaaatggtttgtgagtagagtggaactcatccangaactgcaaagtaaaaattacgatctgggatacgt

SEQ ID NO: 39101 - DNA, 71 bp, chicken (Gallus Gallus)
  misc_feature (36): n=c or t
gcactgtatatcacttggtcacaatctcacaactantttagcctttaatcaggtatggcagacagttccct

SEQ ID NO: 39102 - DNA, 71 bp, chicken (Gallus Gallus)
  misc_feature (36): n=a or c
tagtgagaagagaataaatactaagtgtgttattangacatttatctgaatacatcaaagcaatatgcaag

SEQ ID NO: 39103 - DNA, 71 bp, chicken (Gallus Gallus)
  misc_feature (36): n=a or g
acaggttgtgcactgctccgctgaaagatgttaatnctcatcaccattcagagcactcagactacagaaag

SEQ ID NO: 39104 - DNA, 71 bp, chicken (Gallus Gallus)
  misc_feature (36): n=c or t
cagacaagcgattgatcattctctaacctcatctcngaaatgaaatactctgaacgttcacctctgtcatg

SEQ ID NO: 39105 - DNA, 71 bp, chicken (Gallus Gallus)
  misc_feature (36): n=a or g
gacaggccaccaggagccccacctgtgagcagaatnccccaggttacctgcagtatgtgtggcagggcagg

SEQ ID NO: 39106 - DNA, 71 bp, chicken (Gallus Gallus)
  misc_feature (36): n=c or t
actgcagtgcctctcactattgtataacaagaatgnaacagaagagtggactaggcgagattggcgtagtt

SEQ ID NO: 39107 - DNA, 71 bp, chicken (Gallus Gallus)
  misc_feature (36): n=a or g
atctaaatatatgctatctaaatatttgaaagcacntgcttaaatcctatcagtttcaatgccttttcagg

SEQ ID NO: 39108 - DNA, 71 bp, chicken (Gallus Gallus)
  misc_feature (36): n=c or t
gtgaacctcagtctttctagttcttctagtgctatntgtatcctggtttagcatttacttcccagtacaca

SEQ ID NO: 39109 - DNA, 71 bp, chicken (Gallus Gallus)
  misc_feature (36): n=g or t
cacatgagatgagcaatcttcacagaatcatcactntatcagaatttctcaatcacaaacatcttccaaaa

SEQ ID NO: 39110 - DNA, 71 bp, chicken (Gallus Gallus)
  misc_feature (36): n=g or t
agtgaaatagcagcgaggtgctgctggaccattctncagtgtttcagttactgcttcccctccctttaagc

SEQ ID NO: 39111 - DNA, 71 bp, chicken (Gallus Gallus)
  misc_feature (36): n=c or t
ggggtctcccctgccgaaatgcagcgctttgtcttnttgctgtgccatcacaatccaacactgatcttcag

SEQ ID NO: 39112 - DNA, 71 bp, chicken (Gallus Gallus)
  misc_feature (36): n=c or t
gcccttgtcacaagtcatcctcattatacataacanatgtaacttttggacttgtgttctgccccactgat

SEQ ID NO: 39113 - DNA, 71 bp, chicken (Gallus Gallus)
  misc_feature (36): n=a or g
gtggtgctccaggaaaagcagacacaattctgagcnatgtcttcaaattgctttattcaacagatcttttt

SEQ ID NO: 39114 - DNA, 71 bp, chicken (Gallus Gallus)
  misc_feature (36): n=g or t
tttgccagggttctccagacaggtgttcctgtgcangggcataaatccttttatctgcagatccaacttct

SEQ ID NO: 39115 - DNA, 71 bp, chicken (Gallus Gallus)
  misc_feature (36): n=a or c
agcacagtactgaggggggaatacttgataagaaangtatctggagctgcatgcatacacacacacacaca

SEQ ID NO: 39116 - DNA, 71 bp, chicken (Gallus Gallus)
  misc_feature (36): n=g or t
tgttggaggagatgggctgaataatcattaaaaaangtataaatagcactaacaaatatttacaaaacaca

SEQ ID NO: 39117 - DNA, 71 bp, chicken (Gallus Gallus)
  misc_feature (36): n=c or t
tcgtatttgccaaataccttatacttaaagtctatntaatacaaaacagaccatgagaaaaatatttcctg

SEQ ID NO: 39118 - DNA, 71 bp, chicken (Gallus Gallus)
  misc_feature (36): n=a or g
aactcataggcaaccatgaactatatggaactgatnataataaaatgctaagtgcaactcagcaagaactt

SEQ ID NO: 39119 - DNA, 71 bp, chicken (Gallus Gallus)
  misc_feature (36): n=a or g
cagtgtaattaattctaaattatcagtctataaaanatgcaagtataaaacgactcataagaactcccact

SEQ ID NO: 39120 - DNA, 71 bp, chicken (Gallus Gallus)
  misc_feature (36): n=g or t
taaacaagcaaagaggaaagggtgatttcactgagngactggaggagcaacacaaacagggagggaaaaga

SEQ ID NO: 39121 - DNA, 71 bp, chicken (Gallus Gallus)
  misc_feature (36): n=a or g
acatttaggaactgaagtaacttcagtactgcagcnccatatgaacaatttgctctgttttaccaaacagt

SEQ ID NO: 39122 - DNA, 71 bp, chicken (Gallus Gallus)
  misc_feature (36): n=g or t
atggaagttggttgggcagtgcaagttcattctganttgtcatcaagaattccatatatatacaatatttc

SEQ ID NO: 39123 - DNA, 71 bp, chicken (Gallus Gallus)
  misc_feature (36): n=g or t
caacatttccaccagctcatgtcaaccggggcacanaggcagcccagcccaccttgggtagtggcaaaaga

SEQ ID NO: 39124 - DNA, 71 bp, chicken (Gallus Gallus)
  misc_feature (36): n=c or t
tttcacttttctgttgggcttttaagtaaagcaggngaataatgagatgagatttagctttgagaacggga

SEQ ID NO: 39125 - DNA, 71 bp, chicken (Gallus Gallus)
  misc_feature (36): n=a or g
ggttgtggtttgtccattgatcacttaattagaacngattggtattactgaagtggcaagataaaaacaac

SEQ ID NO: 39126 - DNA, 71 bp, chicken (Gallus Gallus)
  misc_feature (36): n=a or c
acggtgagtccacctaatgctctcagtgaaacaggnatagaaatgcacagtgtggatgctgtgcctatcct

SEQ ID NO: 39127 - DNA, 71 bp, chicken (Gallus Gallus)
  misc_feature (36): n=c or t
tctgggtacttggtaatttgactaacgttttgaagnagcgggtgaattagaacctcacaatgacttcttgc

SEQ ID NO: 39128 - DNA, 71 bp, chicken (Gallus Gallus)
  misc_feature (36): n=g or t
ttaggttgtacagcaaccacgatgaaaacaagatantctcatctgctgagttcaattttttatatacattt

SEQ ID NO: 39129 - DNA, 71 bp, chicken (Gallus Gallus)
  misc_feature (36): n=c or t
ctgggctgtgaaatcacactgccttgttggtatatnggatccttattctgtcttcactaccttgataacag

SEQ ID NO: 39130 - DNA, 71 bp, chicken (Gallus Gallus)
  misc_feature (36): n=g or t
caataggctcaacttcttactggtataattcttttnaagtaaatgcaattgggcagaggagtaattggccc

SEQ ID NO: 39131 - DNA, 71 bp, chicken (Gallus Gallus)
  misc_feature (36): n=g or t
agggagcagcagtacaatagcagtacagcacttccnaagggttagaagagttgtcctgagtgtgaagtaat

SEQ ID NO: 39132 - DNA, 71 bp, chicken (Gallus Gallus)
  misc_feature (36): n=c or t
gagaacagcccttaatgggttctacaaggcctggcngcaaatctagcaggagaaaatactaaaatatgagg

SEQ ID NO: 39133 - DNA, 71 bp, chicken (Gallus Gallus)
  misc_feature (36): n=a or g
gcagaaaatgcaaattaggcatggaaagaggaaatntttgtgtgtgatggccactaaaggcatcagccccc

SEQ ID NO: 39134 - DNA, 71 bp, chicken (Gallus Gallus)
  misc_feature (36): n=c or t
aacttcctcctccaactttcatgcaggatcacaganagtttgcagaggatcctgctgacatacagcatgat

SEQ ID NO: 39135 - DNA, 71 bp, chicken (Gallus Gallus)
  misc_feature (36): n=a or g
ctatttgaagatacaaataaaatgtacgtacataantatatatgcctggtatcccacccattaagatgaag

SEQ ID NO: 39136 - DNA, 71 bp, chicken (Gallus Gallus)
  misc_feature (36): n=a or g
tccagaatcataaggcttatcatttttcttccgttngaggtgaactatctaagggagccaaaagttgcaaa

SEQ ID NO: 39137 - DNA, 71 bp, chicken (Gallus Gallus)
  misc_feature (36): n=a or g
acgaagggacagcagaggccagctccttgcagatgngatgggtgtttctgtcctgcttttaaagacagagt

SEQ ID NO: 39138 - DNA, 71 bp, chicken (Gallus Gallus)
  misc_feature (36): n=c or t
aatgagaagcagctccagaaattatcttcccagccntctgagttctaagaacagacttctctcagctgtac

SEQ ID NO: 39139 - DNA, 71 bp, chicken (Gallus Gallus)
  misc_feature (36): n=c or t
ctcatgttttcctctggacagaaagataaaaactcnttggaagatcttcagatgtatcttgctgatacctt

SEQ ID NO: 39140 - DNA, 71 bp, chicken (Gallus Gallus)
  misc_feature (36): n=c or t
ctttgatagatgtctccataaaatgagaaaaggtcngtgggcttcttagttacaaataagtgtgcataacg

SEQ ID NO: 39141 - DNA, 71 bp, chicken (Gallus Gallus)
  misc_feature (36): n=a or g
gaatcattgagtttgcatgtgttcttcgagatgaangtggtatacacgtgtaaatataaggaagctaattt

SEQ ID NO: 39142 - DNA, 71 bp, chicken (Gallus Gallus)
  misc_feature (36): n=a or g
ctgcatctcataagtggtcttggacccgatcctgcntgctcttgatcttgtgaatgatcccacaggtcgca

SEQ ID NO: 39143 - DNA, 71 bp, chicken (Gallus Gallus)
  misc_feature (36): n=a or g
gtttcttttcctacaacttcccttgaaagtctccantggcactttacaaatggaaggagttaaacctggat

SEQ ID NO: 39144 - DNA, 71 bp, chicken (Gallus Gallus)
  misc_feature (36): n=a or g
aaacaaaagcatgaaggatgtgagactttggcattnatttatgagtgctgcacgtgactggctttgggcac

SEQ ID NO: 39145 - DNA, 71 bp, chicken (Gallus Gallus)
  misc_feature (36): n=c or t
ggcctgatgaggtctgacttttttatgcctctatcngacttctttctttttctctcatgattgacatttgt

SEQ ID NO: 39146 - DNA, 71 bp, chicken (Gallus Gallus)
  misc_feature (36): n=c or t
aggtggtctttacagaattattcttgcagatgccangtgtcagttctttgtaaatagtagtggattggaag

SEQ ID NO: 39147 - DNA, 71 bp, chicken (Gallus Gallus)
  misc_feature (36): n=c or t
actccccggtacacctgtgactgcagctgtaattgnggacagacaggcagtcactgtcagtgttggaagtg

SEQ ID NO: 39148 - DNA, 71 bp, chicken (Gallus Gallus)
  misc_feature (36): n=a or g
tggggtggacgcttcttctcctctcttggagaagcnaacagcttaaaccaatcttgattccatggtgggga

SEQ ID NO: 39149 - DNA, 71 bp, chicken (Gallus Gallus)
  misc_feature (36): n=a or g
cttgtggaaaacaggccacaatgcgtgctgcttttntgggtgttagcactccatccatgttcccattctgg

SEQ ID NO: 39150 - DNA, 71 bp, chicken (Gallus Gallus)
  misc_feature (36): n=a or g
ataacctgagcggggagcagagatttgtcttctgcncacactggtgagctgcaaatgtctgatgaacattt

SEQ ID NO: 39151 - DNA, 71 bp, chicken (Gallus Gallus)
  misc_feature (36): n=a or g
agtgaaactgatcaaaagagtagagagcaaaccagnaaggtgagatcagcacacggtagggaagaagttgg

SEQ ID NO: 39152 - DNA, 71 bp, chicken (Gallus Gallus)
  misc_feature (36): n=g or t
cctcaggccagagcagccatagaacacccactgcangtttcctgctccagagatgaaagctcccatcagca

SEQ ID NO: 39153 - DNA, 71 bp, chicken (Gallus Gallus)
  misc_feature (36): n=a or g
atttaatttggtgcaggctaatctgatctggtaacntgtaatctctgggtgtaggggcccattgaaatctc

SEQ ID NO: 39154 - DNA, 71 bp, chicken (Gallus Gallus)
  misc_feature (36): n=a or g
atatagaagtaagtatgatacctctcaagtgcctcngagctgaaatgctcaaacattagtggaaaagtgag

SEQ ID NO: 39155 - DNA, 71 bp, chicken (Gallus Gallus)
  misc_feature (36): n=a or c
gttattttccaatacaaggtaactggctctgtaaantattcaaaaaacatttactttcccatctgattctc

SEQ ID NO: 39156 - DNA, 71 bp, chicken (Gallus Gallus)
  misc_feature (36): n=g or t
ggaacatcaaccagaacggctcctagacaaaaaggntctgaggaaatgtttcgcttcttgctctttgaaat

SEQ ID NO: 39157 - DNA, 71 bp, chicken (Gallus Gallus)
  misc_feature (36): n=a or g
tggggaaaaaagaataatgaaaggtcaacaaagaanactcatctctccatatctcatccaaacagtgcaac

SEQ ID NO: 39158 - DNA, 71 bp, chicken (Gallus Gallus)
  misc_feature (36): n=g or t
taggtctttattgtgcctcatttgtttgatgtctgntgccactagagggaggtacaaaactgaccacaaaa

SEQ ID NO: 39159 - DNA, 71 bp, chicken (Gallus Gallus)
  misc_feature (36): n=a or c
gtacagcaacctacagaagccctttccactttctgnagacaaagcacatgaccacaggtgttcccttacac

SEQ ID NO: 39160 - DNA, 71 bp, chicken (Gallus Gallus)
  misc_feature (36): n=c or t
catccactctatgacttaccaccaatttactcttantatgctgttaacacagcattagaatttgcatgcaa

SEQ ID NO: 39161 - DNA, 71 bp, chicken (Gallus Gallus)
  misc_feature (36): n=c or t
aaacaagagcaaagttagagtgcaaaaaactgctgnaatctaagtgaaactgcaggattagcatgctggac

SEQ ID NO: 39162 - DNA, 71 bp, chicken (Gallus Gallus)
  misc_feature (36): n=a or g
atgggaggattctttttcatatgggaagcctgtagnaagtattcacgggctcttctgtgacactctaccat

SEQ ID NO: 39163 - DNA, 71 bp, chicken (Gallus Gallus)
  misc_feature (36): n=c or t
tggatagcaattcagacttctcttacctacccatangttgagctctggtgctaatattctgagaaatggtc

SEQ ID NO: 39164 - DNA, 71 bp, chicken (Gallus Gallus)
  misc_feature (36): n=a or c
tttttccaagctttattccaactcagctcttactanggtctcaagttagcattacgagccattggggcctt

SEQ ID NO: 39165 - DNA, 71 bp, chicken (Gallus Gallus)
  misc_feature (36): n=a or g
ccccggggtcagcagtagttcttaactcgaagcacnaggatattttctcccaccaggagttgtcatcaggg

SEQ ID NO: 39166 - DNA, 71 bp, chicken (Gallus Gallus)
  misc_feature (36): n=a or g
aagttccctttactgtaaatggctgggagtttcacngcatgaaatacaacatattgctcatcttccttttc

SEQ ID NO: 39167 - DNA, 71 bp, chicken (Gallus Gallus)
  misc_feature (36): n=a or c
atttatatactgatcctgattctagaagtatgctanattttaaaagacaggatgctattaagcctgatgtg

SEQ ID NO: 39168 - DNA, 71 bp, chicken (Gallus Gallus)
  misc_feature (36): n=a or g
tttcccatactggtcacttctatagatgttttaaantaactgtgccatccaaatgcagaagtgacatttat

SEQ ID NO: 39169 - DNA, 71 bp, chicken (Gallus Gallus)
  misc_feature (36): n=a or g
gggagggtgatggactttgtcactggcaagtgcacngttcttcctctctgctttgtgcaggggtggtcagg

SEQ ID NO: 39170 - DNA, 71 bp, chicken (Gallus Gallus)
  misc_feature (36): n=c or t
ttgacagctaaatattacagcaacccagaatattanagctgctaatatacttaattcatttatacttatag

SEQ ID NO: 39171 - DNA, 71 bp, chicken (Gallus Gallus)
  misc_feature (36): n=a or g
aatccagactctgaaatgatacagtcacagaagcanaaaacacacagctacatgcacacctgtgaagacaa

SEQ ID NO: 39172 - DNA, 71 bp, chicken (Gallus Gallus)
  misc_feature (36): n=c or t
ttccaggtacaatggtcaagctgcaacattttctcnactcaggaccatgctgcagctgctattgcaaaagc

SEQ ID NO: 39173 - DNA, 71 bp, chicken (Gallus Gallus)
  misc_feature (36): n=c or t
agggaaaaaagagctggatattgtcctttttgttgnccttcagatttgttagtctcttcaaagctgggctt

SEQ ID NO: 39174 - DNA, 71 bp, chicken (Gallus Gallus)
  misc_feature (36): n=a or c
taattctccttctgggtctcattagatactgcttanggtaatcaaactattttccttaacttcatcaagct

SEQ ID NO: 39175 - DNA, 71 bp, chicken (Gallus Gallus)
  misc_feature (36): n=a or g
agttctcagtattttcaaagagaggctctggttttntctgagtgaagtttaacagtcaaaaccttggtaaa

SEQ ID NO: 39176 - DNA, 71 bp, chicken (Gallus Gallus)
  misc_feature (36): n=c or t
ctcattttatcacagcatccagtgggattatgtagnttgattttcaagatgcgtggttcctgtactgcatg

SEQ ID NO: 39177 - DNA, 71 bp, chicken (Gallus Gallus)
  misc_feature (36): n=a or g
tgctcttaacttaaatccccccccttttttttttcntgttaagattggctccaactgtcaaccaaagaaac

SEQ ID NO: 39178 - DNA, 71 bp, chicken (Gallus Gallus)
  misc_feature (36): n=a or g
cagaagccaaatttaaaggatggcccttgtgacttntcttgcagtgtttaagaaaacacccctgcagacga

SEQ ID NO: 39179 - DNA, 71 bp, chicken (Gallus Gallus)
  misc_feature (36): n=a or g
gggccatgatgtggggcacatgatcaggcatcaagnagaggtggtagcaggtgccaggtgaaggagatgca

SEQ ID NO: 39180 - DNA, 71 bp, chicken (Gallus Gallus)
  misc_feature (36): n=a or g
tttcaacacgtgtcactgaaatctaatctcgctgcntgagagcagcttgccagcctcattccaaaaggctg

SEQ ID NO: 39181 - DNA, 71 bp, chicken (Gallus Gallus)
  misc_feature (36): n=g or t
agggtgattggaagcctttgatggatgaagctcagntaactggccagggaacttgggaaaattacagtgga

SEQ ID NO: 39182 - DNA, 71 bp, chicken (Gallus Gallus)
  misc_feature (36): n=a or g
gattactaactaccaatttacccaaaagcacacagngggtggcaatgaacagagggtagatggttatatgc

SEQ ID NO: 39183 - DNA, 71 bp, chicken (Gallus Gallus)
  misc_feature (36): n=a or g
cttcatttgtgacaaagatttccatagcaacagacngatctcgctagcaggactgtggtcccctcggaaga

SEQ ID NO: 39184 - DNA, 71 bp, chicken (Gallus Gallus)
  misc_feature (36): n=c or t
tgtcgcccacgtgcagcctgagccttcgagctctgngctgatacagagcccaccgtcccagatgccatggt

SEQ ID NO: 39185 - DNA, 71 bp, chicken (Gallus Gallus)
  misc_feature (36): n=c or t
ccaacgggaccccaccacagctctgagtactagtantgacctgtgttgtgaacagtactgaactgttttgt

SEQ ID NO: 39186 - DNA, 71 bp, chicken (Gallus Gallus)
  misc_feature (36): n=a or c
gcagtgcaaaacgagttatgggtagatcctttagcnaattttgcagtggtcctgtgtaactctgttgcgct

SEQ ID NO: 39187 - DNA, 71 bp, chicken (Gallus Gallus)
  misc_feature (36): n=c or t
gaaaagattgtacagcttacaggatgagagagaaantaaaccgcagcatacaaaaacccaatatcccagct

SEQ ID NO: 39188 - DNA, 71 bp, chicken (Gallus Gallus)
  misc_feature (36): n=a or g
acacctgtgacacagtgagcagcaaggctgccctgngagcttctctttggatctgccacacgtttcccagt

SEQ ID NO: 39189 - DNA, 71 bp, chicken (Gallus Gallus)
  misc_feature (36): n=c or t
gagctgcaccctgggcagatcctggcatctgtaccntcccatccacctgctcaccaatccatgcatcccca

SEQ ID NO: 39190 - DNA, 71 bp, chicken (Gallus Gallus)
  misc_feature (36): n=a or g
aaaagcggtctggctgcacagcctacatatccaaantgcagatgacaagaagtacacacagcagttcctaa

SEQ ID NO: 39191 - DNA, 71 bp, chicken (Gallus Gallus)
  misc_feature (36): n=a or g
tattcccatatccattcacacagatgaggtacccantgactgaatacacccccagaggataagaaacggct

SEQ ID NO: 39192 - DNA, 71 bp, chicken (Gallus Gallus)
  misc_feature (36): n=a or c
ggtaccgccctactgcttcctttgtgcaccgctccntcggatgcttctatccaagcgttacttattccttg

SEQ ID NO: 39193 - DNA, 71 bp, chicken (Gallus Gallus)
  misc_feature (36): n=c or t
ttgcatcttttgtggttctgttaactcttccccttntgttccatatcttcttctctgtgcacttgtctaac

SEQ ID NO: 39194 - DNA, 71 bp, chicken (Gallus Gallus)
  misc_feature (36): n=c or t
ttgttcacatccttgaaaaaagagctggaataattntctgcagaagcaaaagccattgaaagatttgcttc

SEQ ID NO: 39195 - DNA, 71 bp, chicken (Gallus Gallus)
  misc_feature (36): n=a or c
cggtgtttatttttgcctggggtcggggcctccagnagtgagctcccgaaataaacacctttggtggccag

SEQ ID NO: 39196 - DNA, 71 bp, chicken (Gallus Gallus)
  misc_feature (36): n=a or g
tgcatcccctccgagaccctgaccacatgaaaggtntagagaggacaggaagcttatgaagtattttcctt

SEQ ID NO: 39197 - DNA, 71 bp, chicken (Gallus Gallus)
  misc_feature (36): n=c or t
ggatgccgtacagcctgagaacttccacattttcanacttcacccccactttgcaggtttttcaagcagaa

SEQ ID NO: 39198 - DNA, 71 bp, chicken (Gallus Gallus)
  misc_feature (36): n=c or t
agaagggaacaaatagggaggagaaacaatgctgcntatgctaaaggactaactcagaacaagaacaaaca

SEQ ID NO: 39199 - DNA, 71 bp, chicken (Gallus Gallus)
  misc_feature (36): n=c or t
gccagggagacaccagtcttgcaagatgtactttcnttgtgtttcaaacgcataggactcttctccaggtt

SEQ ID NO: 39200 - DNA, 71 bp, chicken (Gallus Gallus)
  misc_feature (36): n=g or t
ttgatagtgtcaaggtctccaatttctccttcagtnctttgtcagtgaggtctactagtggagctaaatga

SEQ ID NO: 39201 - DNA, 71 bp, chicken (Gallus Gallus)
  misc_feature (36): n=a or g
ggcaccacctcctatgcagaccagatgttcctgctnaagagaggactcctagaggtaatgaattgctcaac

SEQ ID NO: 39202 - DNA, 71 bp, chicken (Gallus Gallus)
  misc_feature (36): n=a or g
attcatgtacagacacttacacaggtaaagagctgncagtaactttcttgttatcttgctggtactgcatg

SEQ ID NO: 39203 - DNA, 71 bp, chicken (Gallus Gallus)
  misc_feature (36): n=a or g
tccagccccacgtacaggactagctctctgaagtcnccccttgcttatctcccacttgtgtgtcctgctcc

SEQ ID NO: 39204 - DNA, 71 bp, chicken (Gallus Gallus)
  misc_feature (36): n=a or g
ggaccagcactgagggatgacaagatgcatctcccnggtttcctgaatcaatgggaacagagcagcaggtg

SEQ ID NO: 39205 - DNA, 71 bp, chicken (Gallus Gallus)
  misc_feature (36): n=c or t
gctatgcttcatggtgcagcacatcccagtcatggnatccaagcacacacatcccctgcactgtcccctgg

SEQ ID NO: 39206 - DNA, 71 bp, chicken (Gallus Gallus)
  misc_feature (36): n=c or t
aaattaaagcaggatgtgatgatggtgggagatcangggggatgggaagggatggtgagacgttgacatga

SEQ ID NO: 39207 - DNA, 71 bp, chicken (Gallus Gallus)
  misc_feature (36): n=c or t
acgagaatcctttcttgtcaagaaaacgtctgggcngtgctatctgcaaaaagatattctaggaaatagaa

SEQ ID NO: 39208 - DNA, 71 bp, chicken (Gallus Gallus)
  misc_feature (36): n=c or t
aagttccagaggttatatctttgagtggtagagggncttaaaaggtactacagaccacactagtgctactg

SEQ ID NO: 39209 - DNA, 71 bp, chicken (Gallus Gallus)
  misc_feature (36): n=c or t
ccagtgcaatgtcctcgctgtttgcctgcgtactgnggtcatagggttgctgcctctccctgggtatgtct

SEQ ID NO: 39210 - DNA, 71 bp, chicken (Gallus Gallus)
  misc_feature (36): n=a or g
ttactgcctggagagttttactacttacttatgctntcagctattgcagtttaacatgccatcaatctctc

SEQ ID NO: 39211 - DNA, 71 bp, chicken (Gallus Gallus)
  misc_feature (36): n=a or g
ttcaaggttgcttgtgctgctttgtattgcttttcntagatgagagttctgttggtactctgagcttgtta

SEQ ID NO: 39212 - DNA, 71 bp, chicken (Gallus Gallus)
  misc_feature (36): n=g or t
tgctgtggtgttggcattcccaagtgtactcctgtnctggagaagctctaagacttaaaggagacttatgt

SEQ ID NO: 39213 - DNA, 71 bp, chicken (Gallus Gallus)
  misc_feature (36): n=a or g
gtttgctaggcccagttttgggagggaacagggaantgctgcagtgaagttgagggaatgtaaagaggtgc

SEQ ID NO: 39214 - DNA, 71 bp, chicken (Gallus Gallus)
  misc_feature (36): n=a or g
acctataacagtgaatttaagaatgaaaacgtagcntaacctgtcaagtccagaaaatgaagcttaaatgc

SEQ ID NO: 39215 - DNA, 71 bp, chicken (Gallus Gallus)
  misc_feature (36): n=a or g
tgatcttccccaacgtggatttgttgtttgttatantcagggtgggaaaagtttgccagtattggctgtta

SEQ ID NO: 39216 - DNA, 71 bp, chicken (Gallus Gallus)
  misc_feature (36): n=a or c
ttggcaaggagttgcagacaggataagaacaaattnattgcaggtagtactgcatcttctcttttgcagtg

SEQ ID NO: 39217 - DNA, 71 bp, chicken (Gallus Gallus)
  misc_feature (36): n=a or g
tacaccgtggctcgctgaagaaatagaataggaagncagaagacatatgcagacaggcatatgtgtgcatg

SEQ ID NO: 39218 - DNA, 71 bp, chicken (Gallus Gallus)
  misc_feature (36): n=c or t
tcttgctctacatctctcctagcggtttcatttcangctttaattagaagaaaggagcacatcagtcacgt

SEQ ID NO: 39219 - DNA, 71 bp, chicken (Gallus Gallus)
  misc_feature (36): n=a or g
tcgtagtgctgctgtatttagtcagtaaatgctcancaccaatatactctcattttatgtttttgtttctg

SEQ ID NO: 39220 - DNA, 71 bp, chicken (Gallus Gallus)
  misc_feature (36): n=c or t
aacacagatcatgaacatagaactccatcttcatanggtctaggacactgtttcttttagcgcctggctcc

SEQ ID NO: 39221 - DNA, 71 bp, chicken (Gallus Gallus)
  misc_feature (36): n=a or g
tgcgtaggtccgtgtgtaggttgttaggagaatgcnttttggatctgtcactggctgtttgcaggctgagt

SEQ ID NO: 39222 - DNA, 71 bp, chicken (Gallus Gallus)
  misc_feature (36): n=c or t
aggggtcacaatgcatcacggagcgttatcactttntgagaaaactggaattacttttactcttttgagaa

SEQ ID NO: 39223 - DNA, 71 bp, chicken (Gallus Gallus)
  misc_feature (36): n=a or g
ttatcccagctctgcagtgaaaagctgcggtgctcngggttgtgtttgaatggctcatttggcagaagtag

SEQ ID NO: 39224 - DNA, 71 bp, chicken (Gallus Gallus)
  misc_feature (36): n=c or t
acttcttcagtttgcttgaactggcacaattacacngagctaaagttgatggagcaattctaaagtatacc

SEQ ID NO: 39225 - DNA, 71 bp, chicken (Gallus Gallus)
  misc_feature (36): n=c or t
aacagtgacccttatgcagagctaagaaaacttctnagtgcttttggggggaattttgtgtccctctacca

SEQ ID NO: 39226 - DNA, 71 bp, chicken (Gallus Gallus)
  misc_feature (36): n=c or t
tgaaggatgagtgagcactgcctgtcctataaatgncagtccttctgatatcaagggatggaggggcatga

SEQ ID NO: 39227 - DNA, 71 bp, chicken (Gallus Gallus)
  misc_feature (36): n=a or g
tgcatagagagtggtttgctgtttttcacaaggggnagaaatgcttataggtggtggcttgggtaccatta

SEQ ID NO: 39228 - DNA, 71 bp, chicken (Gallus Gallus)
  misc_feature (36): n=c or t
gatttctaatgtgcaaataaagagtgtttcttgggntcctattaagctcctttctctgttaagctgcatta

SEQ ID NO: 39229 - DNA, 71 bp, chicken (Gallus Gallus)
  misc_feature (36): n=c or t
ggtggaggcaatctcagggctgttagtgcttatcantgaaagctcagggtctgcagttggtcccagaagaa

SEQ ID NO: 39230 - DNA, 71 bp, chicken (Gallus Gallus)
  misc_feature (36): n=c or t
ccttaaaatatgcttaaataatgccccagtgttctntaggcatcttgatggagaatattaagaaatacaaa

SEQ ID NO: 39231 - DNA, 71 bp, chicken (Gallus Gallus)
  misc_feature (36): n=a or g
tgaaatcgtcttgcagtgatttgcactgaccggtgntaaggacaaccaccatggctgtgcatgcagcacag

SEQ ID NO: 39232 - DNA, 71 bp, chicken (Gallus Gallus)
  misc_feature (36): n=a or g
tatgctaggtgtttatgagcacagagagagaggtcnggaccattgtattcctgtttatttgcatgtaaacc

SEQ ID NO: 39233 - DNA, 71 bp, chicken (Gallus Gallus)
  misc_feature (36): n=a or g
agatggactgcttggtgtgcctggcctatccctgantgtaagaaagcaaaagtaggtgagacagccttgcc

SEQ ID NO: 39234 - DNA, 71 bp, chicken (Gallus Gallus)
  misc_feature (36): n=a or g
tactccagtagcaaccccagcacagctttttgggantgccaaatgtaaaaccaacattagtatgttggtta

SEQ ID NO: 39235 - DNA, 71 bp, chicken (Gallus Gallus)
  misc_feature (36): n=a or g
tggtaactcatggagcaacttgaagatattatgccntggccatggatgataggatagccaaatcctgtata

SEQ ID NO: 39236 - DNA, 71 bp, chicken (Gallus Gallus)
  misc_feature (36): n=a or g
taagttttttgatacaacttgaattgttactaaagntcagagtattgttttcttgtacactaagcaagtag

SEQ ID NO: 39237 - DNA, 71 bp, chicken (Gallus Gallus)
  misc_feature (36): n=a or c
actttcgaccttggagctttgttttgtgctgagatnattcctttcccaaatgtcgttatcagctgtgattt

SEQ ID NO: 39238 - DNA, 71 bp, chicken (Gallus Gallus)
  misc_feature (36): n=c or t
agctattgggatttctatattcctcattcagtttcngtcaaggggccattggctcatcacagttcagtaaa

SEQ ID NO: 39239 - DNA, 71 bp, chicken (Gallus Gallus)
  misc_feature (36): n=a or c
ccttcagtaccttggtgcttctgcttagtgcagctnggtccctgcgcttggattgctccactgtttgggct

SEQ ID NO: 39240 - DNA, 71 bp, chicken (Gallus Gallus)
  misc_feature (36): n=c or t
gtcttcaaatgttgaaatcttggactttctaagtanggggctgctatgcatggacacacttcctgctaatc

SEQ ID NO: 39241 - DNA, 71 bp, chicken (Gallus Gallus)
  misc_feature (36): n=a or g
gcttcagatgagatagcaatgaaaaagttcaagatnaacagatggaacttattctttaaaaaagatttaag

SEQ ID NO: 39242 - DNA, 71 bp, chicken (Gallus Gallus)
  misc_feature (36): n=a or g
gaatattttcatgggatatcagtctcagcgttcccngaattagcatgctcactgaaggattgaagatgctt

SEQ ID NO: 39243 - DNA, 71 bp, chicken (Gallus Gallus)
  misc_feature (36): n=a or c
gtcagcttgtcctgacttggtgaaggagcagaacantgccctgggtctgagtggcttgctgaaccttgggg

SEQ ID NO: 39244 - DNA, 71 bp, chicken (Gallus Gallus)
  misc_feature (36): n=a or c
agcatcttcaccctcaattggcaaatcgtctttatnaatgagtggaacccaactgtctcagtgaagaaaca

SEQ ID NO: 39245 - DNA, 71 bp, chicken (Gallus Gallus)
  misc_feature (36): n=c or t
ctctgggtttgaaaataactttcagtgcattcagantttaccagccccttgaagttgtttcttgcttgaga

SEQ ID NO: 39246 - DNA, 71 bp, chicken (Gallus Gallus)
  misc_feature (36): n=c or t
ccgaggtcagagttatctgatatgtcccggatcccnttctcctgcacttgtcatcttctcccactctcgat

SEQ ID NO: 39247 - DNA, 71 bp, chicken (Gallus Gallus)
  misc_feature (36): n=a or g
aggcataggttcctactatcagctggaagtcaacantgctcactcggtaagcacgcgtctgatgtatcata

SEQ ID NO: 39248 - DNA, 71 bp, chicken (Gallus Gallus)
  misc_feature (36): n=a or g
tacattctcatccactatgctcttagcagcaggacnagcaggacctccttgcctggcagtggtttctgcag

SEQ ID NO: 39249 - DNA, 71 bp, chicken (Gallus Gallus)
  misc_feature (36): n=a or g
cttacttgccagtctgttttctgtgaagagtaatgncctttacatttaggcctaggtaaaggcccagtgca

SEQ ID NO: 39250 - DNA, 71 bp, chicken (Gallus Gallus)
  misc_feature (36): n=c or t
ttctgagttgcaagcaccaactccaagtgtttcaantagaaaaagcgttaggtgtcagagggtggaaggag

SEQ ID NO: 39251 - DNA, 71 bp, chicken (Gallus Gallus)
  misc_feature (36): n=c or t
gtctgcattgaactgtaagcctccactcagagatancagtgccagaaacagagcttgtggcacacttaaag

SEQ ID NO: 39252 - DNA, 71 bp, chicken (Gallus Gallus)
  misc_feature (36): n=c or t
tgggcgcctcccggtacatctcgtccacctcctcgncagtgaacctgtctcccatggtggtcagcagttca

SEQ ID NO: 39253 - DNA, 71 bp, chicken (Gallus Gallus)
  misc_feature (36): n=a or g
agttcggccacagtgagataatgtggtcgcaggatnggatgtggggacgggggagaccagggctttgctaa

SEQ ID NO: 39254 - DNA, 71 bp, chicken (Gallus Gallus)
  misc_feature (36): n=a or g
taacccccagcaaagtgcaggccaagctccttctcnggcaaacaccgatgtctgagcttgcacagattgtc

SEQ ID NO: 39255 - DNA, 71 bp, chicken (Gallus Gallus)
  misc_feature (36): n=a or g
tccaggtgctgtgctcaccaacaacaggtaactgcngttgctctgcacttatagagaccaaccttctggag

SEQ ID NO: 39256 - DNA, 71 bp, chicken (Gallus Gallus)
  misc_feature (36): n=c or t
gataaagggcattcacttcaggacacacataatccngatttctcaggactgcaaagctgatcacattgctg

SEQ ID NO: 39257 - DNA, 71 bp, chicken (Gallus Gallus)
  misc_feature (36): n=c or t
ggttttgttactttccctggaaacaagagagctttnttaaagagagaaactgcagcaatgggatgaccatc

SEQ ID NO: 39258 - DNA, 71 bp, chicken (Gallus Gallus)
  misc_feature (36): n=c or t
gttagcctaaagcattgcaacaaagggagtgactgngctcctgtcgggtcctttctcttggtctgtatcct

SEQ ID NO: 39259 - DNA, 71 bp, chicken (Gallus Gallus)
  misc_feature (36): n=c or t
acagaggtgtaacacatctttgggccgtgttccccnatagctgttaagccaaggcagagctcttcagctag

SEQ ID NO: 39260 - DNA, 71 bp, chicken (Gallus Gallus)
  misc_feature (36): n=c or t
ttatagcaagtacttaacatctcattgactcaaatncctctgttaatgatttcactggattcctgttaaag

SEQ ID NO: 39261 - DNA, 71 bp, chicken (Gallus Gallus)
  misc_feature (36): n=c or t
tttctgtgtggaaaaaagaagggccagatagttccngtgaatgctgcatttcatagtgttgcttcacccag

SEQ ID NO: 39262 - DNA, 71 bp, chicken (Gallus Gallus)
  misc_feature (36): n=c or t
cctttgcaggctgcatgcaattttgtcaaatcccangtggactccagcagtgttgattcccttttctatgc

SEQ ID NO: 39263 - DNA, 71 bp, chicken (Gallus Gallus)
  misc_feature (36): n=a or g
aaccgagaaatagttaagctaccatttgtgctattntactccagaattccttttcaccctgatgagttcct

SEQ ID NO: 39264 - DNA, 71 bp, chicken (Gallus Gallus)
  misc_feature (36): n=c or t
aaagctattggtgagcacatgcaaacctttcttttnccctgtttgagtattttcttggctcatcttatggg

SEQ ID NO: 39265 - DNA, 71 bp, chicken (Gallus Gallus)
  misc_feature (36): n=a or g
gatttactgcaggaagttttatgtgccctaaacagngggcagcctaccaattgtggtgttctctggctgta

SEQ ID NO: 39266 - DNA, 71 bp, chicken (Gallus Gallus)
  misc_feature (36): n=c or t
gatggatctgtggtcctcagccctccctgagcaagngcttcggggagtaaaggctgtagggagggctgtgc

SEQ ID NO: 39267 - DNA, 71 bp, chicken (Gallus Gallus)
  misc_feature (36): n=a or g
ttctgcactgacatgcagccatccaagcaggtaacncagtatgatggcgtgcacactgttgggagcttttc

SEQ ID NO: 39268 - DNA, 71 bp, chicken (Gallus Gallus)
  misc_feature (36): n=a or g
agattacagaacacaagttgtcctggaggcacaacncacttcatctactgggattaattcctaacgtacat

SEQ ID NO: 39269 - DNA, 71 bp, chicken (Gallus Gallus)
  misc_feature (36): n=a or c
gcctgaaggactgctcagactccaactaggcaatancagaatgaatttcacctgtaccattccatcccagc

SEQ ID NO: 39270 - DNA, 71 bp, chicken (Gallus Gallus)
  misc_feature (36): n=c or t
taaaaccccctggatttagagagtgaagtccagggntagcacatgaggttaatgtgtttgtaagaaatgga

SEQ ID NO: 39271 - DNA, 71 bp, chicken (Gallus Gallus)
  misc_feature (36): n=a or g
ctttatagctagctgagccatcgcgtgctcctctcntagcctgagcaagggcagtattaattatgacactg

SEQ ID NO: 39272 - DNA, 71 bp, chicken (Gallus Gallus)
  misc_feature (36): n=a or g
gctctgccgcgccccaacccgctcagcatccgagcnaaggcgtagggcatcccgctcagcccggacagcgc

SEQ ID NO: 39273 - DNA, 71 bp, chicken (Gallus Gallus)
  misc_feature (36): n=a or g
ttatgtgcaatcagctctcgggatgattgttttggnctgtcattagcgcagcacaccatgctgctttcagg

SEQ ID NO: 39274 - DNA, 71 bp, chicken (Gallus Gallus)
  misc_feature (36): n=a or g
tccagcagcttaagaagcggcctgtcacagagtganggcatgtcttgtcacagccatccattagcactcaa

SEQ ID NO: 39275 - DNA, 71 bp, chicken (Gallus Gallus)
  misc_feature (36): n=c or t
gcagatctctgtgctgttcagcttgaccagcatggntcagagtggatgtgcccctgttgtcacagggctga

SEQ ID NO: 39276 - DNA, 71 bp, chicken (Gallus Gallus)
  misc_feature (36): n=a or g
gcttaaatgtattgggttatctcatcatactcccanagcacaagtccttcccaaaacagagtatctggtga

SEQ ID NO: 39277 - DNA, 71 bp, chicken (Gallus Gallus)
  misc_feature (36): n=a or g
gctcagcagtgccacgttgctgagctgtccctcccncctcttgtttttcatggctatctgagtctgtgtgt

SEQ ID NO: 39278 - DNA, 71 bp, chicken (Gallus Gallus)
  misc_feature (36): n=a or g
gctgctgctcagccagggcagggaacacaggtgtcnagggagtgttattcaaggtctgccctattctgggg

SEQ ID NO: 39279 - DNA, 71 bp, chicken (Gallus Gallus)
  misc_feature (36): n=c or t
gtttttttcagggggtgtaaaagagttgtgcaaaanaaacagagtgaaggtccttgcaaaaagcctatgca

SEQ ID NO: 39280 - DNA, 71 bp, chicken (Gallus Gallus)
  misc_feature (36): n=a or g
gcagatgatctgggcagtgactgccgggcagctggnggcagtgcttctgttggacagcttctcactggctt

SEQ ID NO: 39281 - DNA, 71 bp, chicken (Gallus Gallus)
  misc_feature (36): n=a or g
taacgaattccttctggactgttcccaaagctgaantgagacagaacaactatgaagaattatgcaaacct

SEQ ID NO: 39282 - DNA, 71 bp, chicken (Gallus Gallus)
  misc_feature (36): n=c or t
cagaggccaaaacttgtccgttccctctctcggctnctctcctttctaatacttgagactcttttccagta

SEQ ID NO: 39283 - DNA, 71 bp, chicken (Gallus Gallus)
  misc_feature (36): n=c or t
aagagccagccaggtttggattctatttgatagccngggtttgactaattcccacgagctgaaataaaatt

SEQ ID NO: 39284 - DNA, 71 bp, chicken (Gallus Gallus)
  misc_feature (36): n=c or t
gaacaaattcaaggttattgtcatctgataatgaantgtagaggtgtaaagagggttcagtggaaatggca

SEQ ID NO: 39285 - DNA, 71 bp, chicken (Gallus Gallus)
  misc_feature (36): n=g or t
tccagctgcttcttcacttcagcaatcaaacgatcncgttcctgttcgagactctgacgcatttcagccat

SEQ ID NO: 39286 - DNA, 71 bp, chicken (Gallus Gallus)
  misc_feature (36): n=a or g
ttattaatttttctacatcaccagtattaacataantaattatgaatgttcttgcaaaacatccaccaagg

SEQ ID NO: 39287 - DNA, 71 bp, chicken (Gallus Gallus)
  misc_feature (36): n=c or t
aattgatgctacagctaaacacaggggggtgtcaantgaaaaggcatattccccagttatgcttctctaac

SEQ ID NO: 39288 - DNA, 71 bp, chicken (Gallus Gallus)
  misc_feature (36): n=c or t
gggaaggaagaagaacgtggtgctcagctcctgcanagctgctcctacagacacgcagcccccaggacagc

SEQ ID NO: 39289 - DNA, 71 bp, chicken (Gallus Gallus)
  misc_feature (36): n=g or t
ttgtagctagtgtaggacagggtggaaaaggatagncttcccagattaatagctgctttgggaaaacaaat

SEQ ID NO: 39290 - DNA, 71 bp, chicken (Gallus Gallus)
  misc_feature (36): n=c or t
ctgggacgttttaagctatggtacgtgtcatacatngcacattttcattatattggattttttatttattt

SEQ ID NO: 39291 - DNA, 71 bp, chicken (Gallus Gallus)
  misc_feature (36): n=a or g
gcaggttctatttcaagtcttgtatggccatgaatntaatactaagatgcacatactggaaggcaaaaaaa

SEQ ID NO: 39292 - DNA, 71 bp, chicken (Gallus Gallus)
  misc_feature (36): n=c or t
atgttgggttatatagagtaacacatttgaagtatnaccttaaagttttgatagatgacatttcagatttt

SEQ ID NO: 39293 - DNA, 71 bp, chicken (Gallus Gallus)
  misc_feature (36): n=c or t
aaaatatgttggaggcaatggatggtgttctttttncactgaatttgagtttgtacagctttagttttact

SEQ ID NO: 39294 - DNA, 71 bp, chicken (Gallus Gallus)
  misc_feature (36): n=c or t
actgtcccaggaaggagaaacaacacagcccatgcngatgggtcactttaaaacaggtatccttaactatg

SEQ ID NO: 39295 - DNA, 71 bp, chicken (Gallus Gallus)
  misc_feature (36): n=a or g
gtgtcagtagtcttggggaggagaaagccaccagcntttgactataattggcagcttcagcagaaaggcaa

SEQ ID NO: 39296 - DNA, 71 bp, chicken (Gallus Gallus)
  misc_feature (36): n=c or t
atgcctctgggattcccagctctgccccctgaatgnctgagaaagcggaaccagacgtgggcgttcgctgc

SEQ ID NO: 39297 - DNA, 71 bp, chicken (Gallus Gallus)
  misc_feature (36): n=a or g
cataaatcatggaaaatcaatcctaaaatggcacanttctttcttgtatagtgtgttggatacaacctgtt

SEQ ID NO: 39298 - DNA, 71 bp, chicken (Gallus Gallus)
  misc_feature (36): n=g or t
cccagcagtatgagaattcttcaagccaaagacaangtatgtgaagactgaaaggtaatgtaatgcacaga

SEQ ID NO: 39299 - DNA, 71 bp, chicken (Gallus Gallus)
  misc_feature (36): n=a or g
cctccttcactggaacttcatctattcttacacaancctccatggcaagcactaagttggggctgaagtct

SEQ ID NO: 39300 - DNA, 71 bp, chicken (Gallus Gallus)
  misc_feature (36): n=a or g
tgtagatttgaaagtctctgccactggagaggcctngtccaacaaggtccaagagatcaaattaggtttct

SEQ ID NO: 39301 - DNA, 71 bp, chicken (Gallus Gallus)
  misc_feature (36): n=a or g
ttcatcccgttagtaagaaaaatcagggctgagacncaggcatggctttaagaggaggaattgcggaagtc

SEQ ID NO: 39302 - DNA, 71 bp, chicken (Gallus Gallus)
  misc_feature (36): n=a or g
ttcacttacgtcaaacgtactgttaccaagctctgngtctattgactttagagcatgtaatgttggactag

SEQ ID NO: 39303 - DNA, 71 bp, chicken (Gallus Gallus)
  misc_feature (36): n=a or g
caccttttataaactgcaaagcacggacatgattcntaagtaaattcttattctaaatagggaggaactgg

SEQ ID NO: 39304 - DNA, 71 bp, chicken (Gallus Gallus)
  misc_feature (36): n=c or t
tatagatacctggaattaaactggcttagttgttgnataatgcagctatttctgtgatggaaacatggctg

SEQ ID NO: 39305 - DNA, 71 bp, chicken (Gallus Gallus)
  misc_feature (36): n=c or t
atcattaaaggctatgcatctggaggggaagagttnatgggcctcggattaggtaagataaataatcttga

SEQ ID NO: 39306 - DNA, 71 bp, chicken (Gallus Gallus)
  misc_feature (36): n=a or g
ataaaacccataaccaccagacctggtgcatttggncatataattagcaaggcagtaaaaggcctccccct

SEQ ID NO: 39307 - DNA, 71 bp, chicken (Gallus Gallus)
  misc_feature (36): n=a or g
tatttcttgttggttgaatgtttattgtcttgaaantggcacataaacacggctgtttggctggaaatggc

SEQ ID NO: 39308 - DNA, 71 bp, chicken (Gallus Gallus)
  misc_feature (36): n=c or t
gacatagaagatactccaggatatcagactgcattntctcagctagcctttgctggaaagaaagaacatga

SEQ ID NO: 39309 - DNA, 71 bp, chicken (Gallus Gallus)
  misc_feature (36): n=a or g
gcagcgtacagccgcactgcactgttgctctgtccntgctgacagatcactgtcctttagacaccttttcc

SEQ ID NO: 39310 - DNA, 71 bp, chicken (Gallus Gallus)
  misc_feature (36): n=c or t
caaaaaatgcagtgtcccttaaacacaaattcagcntgaaagacaggcagtctgaggcaaaaaggttttga

SEQ ID NO: 39311 - DNA, 71 bp, chicken (Gallus Gallus)
  misc_feature (36): n=a or g
tgcgctgcagtgtggaacaggtcagactgtgggtgntcagggatgagcttgggggtcttcagcaggtgaga

SEQ ID NO: 39312 - DNA, 71 bp, chicken (Gallus Gallus)
  misc_feature (36): n=a or g
cttcagctacaatgtggctgtgatccatttatgtcntttttggaggaaaacccatgacagtctgtattaag

SEQ ID NO: 39313 - DNA, 71 bp, chicken (Gallus Gallus)
  misc_feature (36): n=g or t
gagcatcccacaggctttcatcttcagttccctcanactgggagcaaaggtggtttgtgcttgtaatgcct

SEQ ID NO: 39314 - DNA, 71 bp, chicken (Gallus Gallus)
  misc_feature (36): n=c or t
agatgcaggagcactgtagaagttgtatttctacantggttacatcactcaatgaaaggagactttgcaaa

SEQ ID NO: 39315 - DNA, 71 bp, chicken (Gallus Gallus)
  misc_feature (36): n=a or g
gtaatataaaaaagtgcctgtggccaatgctcagcntgcacttaccagatctttccatagcgtatatttcc

SEQ ID NO: 39316 - DNA, 71 bp, chicken (Gallus Gallus)
  misc_feature (36): n=g or t
aaaaagcagaacggtggctgccttcacagcttgggnttatttctgcaaatctggcactgctcccttccgct

SEQ ID NO: 39317 - DNA, 71 bp, chicken (Gallus Gallus)
  misc_feature (36): n=a or c
catctcagccttggtgcacatcccagctgtcccatnatgactatccatccttcatgaaacctgtaactctc

SEQ ID NO: 39318 - DNA, 71 bp, chicken (Gallus Gallus)
  misc_feature (36): n=c or t
ctaggacctcattttcctacaagatttggcaagttnccaacagcctttttttgactttcatgaatgagcga

SEQ ID NO: 39319 - DNA, 71 bp, chicken (Gallus Gallus)
  misc_feature (36): n=a or g
ccaagacactcaagcaaaggagtagaaattttagtntggttcaaagtgcacaaaagggaacatgtaagcat

SEQ ID NO: 39320 - DNA, 71 bp, chicken (Gallus Gallus)
  misc_feature (36): n=c or t
gctatgagcttaatgctaagcagatgcttaagactngttgacttcagagggacgactcacgtgctggaagt

SEQ ID NO: 39321 - DNA, 71 bp, chicken (Gallus Gallus)
  misc_feature (36): n=c or t
attcacctcaggtctaaagccaaaggcagttatttnatggaggaaaaatgcatgaacttttctgctggctg

SEQ ID NO: 39322 - DNA, 71 bp, chicken (Gallus Gallus)
  misc_feature (36): n=c or t
cagtacctgacaaatgaggctgcactccccattccnagcatttatgctatgccatcccaccaagtgactca

SEQ ID NO: 39323 - DNA, 71 bp, chicken (Gallus Gallus)
  misc_feature (36): n=c or t
aagatgtatattcagttctgaaagtgaagggaaagnctgcaggtattttgagttgtcagcctagtgcacat

SEQ ID NO: 39324 - DNA, 71 bp, chicken (Gallus Gallus)
  misc_feature (36): n=c or t
taattcaggagtttgcatcgatattcattgtggttncagctcattcaacacaatgatgcattttatgcttc

SEQ ID NO: 39325 - DNA, 71 bp, chicken (Gallus Gallus)
  misc_feature (36): n=a or g
atacaataacaaggaattttcactgtactacacacntccagggagttataacactgagatgtgattttcca

SEQ ID NO: 39326 - DNA, 71 bp, chicken (Gallus Gallus)
  misc_feature (36): n=c or t
agatttaaacactttgaccaaacctacaatctatanggccctcggtcagaagtcaataggagttagtagag

SEQ ID NO: 39327 - DNA, 71 bp, chicken (Gallus Gallus)
  misc_feature (36): n=c or t
gttgggaaagaaccgcctgcttaggctgactgccangctgagagatgaggactcctacatatactttgcac

SEQ ID NO: 39328 - DNA, 71 bp, chicken (Gallus Gallus)
  misc_feature (36): n=c or t
aggaactgttaactacaaacttaactaatagtccangaaaataacatgcctgtttagcaccagtgcagaca

SEQ ID NO: 39329 - DNA, 71 bp, chicken (Gallus Gallus)
  misc_feature (36): n=g or t
taagcataagcattgtaaaagatgatttgcacaatncatatcagaagtaaaataaggtggatgcatttttg

SEQ ID NO: 39330 - DNA, 71 bp, chicken (Gallus Gallus)
  misc_feature (36): n=a or g
tacggtacaagggacagaaaacagaagtgtactagntggaacttgggacagaagcatcaaatcagtgcagg

SEQ ID NO: 39331 - DNA, 71 bp, chicken (Gallus Gallus)
  misc_feature (36): n=c or t
ttggtgtaataactttaaggaagtaacagaactttnacctgatctgtactgcagagaactgtgcatatgca

SEQ ID NO: 39332 - DNA, 71 bp, chicken (Gallus Gallus)
  misc_feature (36): n=c or t
atgcatgggaaaacttcagcaatctgccttgaatcnatgtgaagctgaaattgttgtaaacatctgaatat

SEQ ID NO: 39333 - DNA, 71 bp, chicken (Gallus Gallus)
  misc_feature (36): n=g or t
ccacaatcctagctatcaaaagaagttcatcacacncagagatctttaaacaatctttcattctgttttgt

SEQ ID NO: 39334 - DNA, 71 bp, chicken (Gallus Gallus)
  misc_feature (36): n=c or t
agttgaagtatatatcttttagcctttaagagtccnaatgagttatttcaaattggagaagggaagaaaaa

SEQ ID NO: 39335 - DNA, 71 bp, chicken (Gallus Gallus)
  misc_feature (36): n=a or c
ccttctgatgccaagttcctctcaaaggaccatganaactgtttttcaatgaggaaactagttttcttcaa

SEQ ID NO: 39336 - DNA, 71 bp, chicken (Gallus Gallus)
  misc_feature (36): n=a or c
tgataaggttctgaatttatggaatccagtcacaanagaagctaatgctgcttttgccatacaagcatgcc

SEQ ID NO: 39337 - DNA, 71 bp, chicken (Gallus Gallus)
  misc_feature (36): n=c or t
ctggctgtagtaaagcaaagcatcatattttcctgnggctatacaacacttggctatgcatctttctatct

SEQ ID NO: 39338 - DNA, 71 bp, chicken (Gallus Gallus)
  misc_feature (36): n=g or t
cttgctgcgctgatcaaacccagtgcagaaagaatnataagagattctagatgccaaactctaacaagttt

SEQ ID NO: 39339 - DNA, 71 bp, chicken (Gallus Gallus)
  misc_feature (36): n=c or t
gggaaaaggattatctccctactcctcagatcatcngaagttactctccctctttcaaccatgcagttttg

SEQ ID NO: 39340 - DNA, 71 bp, chicken (Gallus Gallus)
  misc_feature (36): n=g or t
aaaagtagaaattaagacattctctgcttcccgggngtctgatcttcataactgaaaactctgaaacaaat

SEQ ID NO: 39341 - DNA, 71 bp, chicken (Gallus Gallus)
  misc_feature (36): n=c or t
cctacagagctcaatacaatgaggtctcagttcgtnactaacatctctaggtgttaacacaatgccattaa

SEQ ID NO: 39342 - DNA, 71 bp, chicken (Gallus Gallus)
  misc_feature (36): n=c or t
gtaaagagaggctgaggaacatcagctctctgcatnaggtttgtgtgtgctcgtgtgaagttgtttctcag

SEQ ID NO: 39343 - DNA, 71 bp, chicken (Gallus Gallus)
  misc_feature (36): n=g or t
tttaatgaatataacacaactgtagtaccagtgaangtatcctgcttgagcttggggaattgtgccatgag

SEQ ID NO: 39344 - DNA, 71 bp, chicken (Gallus Gallus)
  misc_feature (36): n=c or t
tgttttccacatgcagtcacattcctggcattaccngtgtcaccaacatcttgtggctgtgcagaacaaca

SEQ ID NO: 39345 - DNA, 71 bp, chicken (Gallus Gallus)
  misc_feature (36): n=c or t
aatttataaaattatagagagtttcctggatagcangcacataatgaaccatgtgtacttttaatagcaca

SEQ ID NO: 39346 - DNA, 71 bp, chicken (Gallus Gallus)
  misc_feature (36): n=a or g
gtgtaaatttttttatttgaaactctataattcatntatgttatttgcttcttggagtagtctcaatgtat

SEQ ID NO: 39347 - DNA, 71 bp, chicken (Gallus Gallus)
  misc_feature (36): n=g or t
tccgattcaaaaggcatttcctcgtgctgttagatntgacattttcaaagaatctcagactgtctcatcat

SEQ ID NO: 39348 - DNA, 71 bp, chicken (Gallus Gallus)
  misc_feature (36): n=a or c
taaacttttgcgattctttccccatatgtacaacgnttctgttcactttagcaattacagctactagtttt

SEQ ID NO: 39349 - DNA, 71 bp, chicken (Gallus Gallus)
  misc_feature (36): n=a or g
tgagtcccaagctgtgctttgcaaggagtcttcagntagggatgtctatcaggtattaaatttattggact

SEQ ID NO: 39350 - DNA, 71 bp, chicken (Gallus Gallus)
  misc_feature (36): n=a or g
ttcaaatatcctgctgtctgcagctcttgtatccangtcaggtaaaccataagccctgctattttttattt

SEQ ID NO: 39351 - DNA, 71 bp, chicken (Gallus Gallus)
  misc_feature (36): n=c or t
tctcagcccctacttattcccacatcacagctggcnaacacatcaggctgtcacagtacagagagcaaaca

SEQ ID NO: 39352 - DNA, 71 bp, chicken (Gallus Gallus)
  misc_feature (36): n=a or g
gttttgtgtgggaacggagattacagtttttcacanggctagaaaagggcttatctcatgatcaaagccca

SEQ ID NO: 39353 - DNA, 71 bp, chicken (Gallus Gallus)
  misc_feature (36): n=c or t
ggttatccgtgatggtgcccagggtggggatcctgnttacaactgtagctgcgtgactagttgattttcta

SEQ ID NO: 39354 - DNA, 71 bp, chicken (Gallus Gallus)
  misc_feature (36): n=c or t
gggctctcccagccagaaaatcttgtcttccatctncaggggaaaatctgtcatcctcacagcaccatcaa

SEQ ID NO: 39355 - DNA, 71 bp, chicken (Gallus Gallus)
  misc_feature (36): n=a or g
tgcacattgttttctgatgtgtcatcatctgaatcnctaagaaagccctcaaataaaactgagttaactca

SEQ ID NO: 39356 - DNA, 71 bp, chicken (Gallus Gallus)
  misc_feature (36): n=c or t
gaaagaaacctctctacaaggaattcctcctcctgncttaatatgcagccttaatttctcttcattaattt

SEQ ID NO: 39357 - DNA, 71 bp, chicken (Gallus Gallus)
  misc_feature (36): n=a or g
agtattagtttatgagtgggaaagcaccaggactgnaaatggcagctgtgtgtgctctgcttggttttaaa

SEQ ID NO: 39358 - DNA, 71 bp, chicken (Gallus Gallus)
  misc_feature (36): n=a or g
aataaataataaaacctgtaaactagatccataccntcttcgcttaggtatttttccatataggggcagat

SEQ ID NO: 39359 - DNA, 71 bp, chicken (Gallus Gallus)
  misc_feature (36): n=c or t
tggggcatctcctgtttcccttttgaagtctgaacntgaaaagtgatttatttattttgtaatggataggt

SEQ ID NO: 39360 - DNA, 71 bp, chicken (Gallus Gallus)
  misc_feature (36): n=a or c
aatgattccatgaaactgaaagtgagttttaagtancgaaaagattttctgaacagaattctctataacaa

SEQ ID NO: 39361 - DNA, 71 bp, chicken (Gallus Gallus)
  misc_feature (36): n=c or t
atctgtttcagtttgcaaagctcctataagtatatncacaagcctcagcttcaaggaaaggaaggttactg

SEQ ID NO: 39362 - DNA, 71 bp, chicken (Gallus Gallus)
  misc_feature (36): n=a or c
tctgacaaacctcgaaaccaagattaataatcattncaagagctggagttcagaatgaccactaaaacctg

SEQ ID NO: 39363 - DNA, 71 bp, chicken (Gallus Gallus)
  misc_feature (36): n=c or t
aatagggtgagcatctttaaatctagtcttagcccntaacataatctgtatttctattactgttctggttt

SEQ ID NO: 39364 - DNA, 71 bp, chicken (Gallus Gallus)
  misc_feature (36): n=c or t
cagttctattgttagagcagaaagcagacattctanatgttacaaccaggaaaggcatcagaagtattttt

SEQ ID NO: 39365 - DNA, 71 bp, chicken (Gallus Gallus)
  misc_feature (36): n=c or t
caaggcgctttgtttttccatgttgccttcccttantctgttgcaatgcctgatctgtaaccctgctgcac

SEQ ID NO: 39366 - DNA, 71 bp, chicken (Gallus Gallus)
  misc_feature (36): n=a or g
tgtgcctggaagtacttgaagactacatgggttaanggcttcagtgatgctggaaaacaagaaaattgagt

SEQ ID NO: 39367 - DNA, 71 bp, chicken (Gallus Gallus)
  misc_feature (36): n=c or t
tccaccccaagcaaaaagctccagcctctagccttncctctctccaagaggtgtcccagatacctccagca

SEQ ID NO: 39368 - DNA, 71 bp, chicken (Gallus Gallus)
  misc_feature (36): n=g or t
caaacctgccaaattcttactgcaaatcacatgggngattttgagaagcattgacattctccaaagaaagg

SEQ ID NO: 39369 - DNA, 71 bp, chicken (Gallus Gallus)
  misc_feature (36): n=a or g
ttgagaggacatttgaatggaactgaagttcactgnaggggattgtagtgaagacagccaaagccacagag

SEQ ID NO: 39370 - DNA, 71 bp, chicken (Gallus Gallus)
  misc_feature (36): n=a or c
cctctcctgttgggacagggcaagtgttcagatctnctaagcacactgaccatctatagccagtggaagct

SEQ ID NO: 39371 - DNA, 71 bp, chicken (Gallus Gallus)
  misc_feature (36): n=a or g
atgtgatacacaaaatctgtctctgcactgtgggcncttcaaggactgctacacttgtatcagcagcgaag

SEQ ID NO: 39372 - DNA, 71 bp, chicken (Gallus Gallus)
  misc_feature (36): n=a or g
agccaaatgtcgaaggatgtgcttttctgattgacntatgctaacaatacagcctccacagccaggaggag

SEQ ID NO: 39373 - DNA, 71 bp, chicken (Gallus Gallus)
  misc_feature (36): n=a or g
catttttttaaaaatcctgattacccccgagaaacnctttggaatttgccattattgtccagttctcaact

SEQ ID NO: 39374 - DNA, 71 bp, chicken (Gallus Gallus)
  misc_feature (36): n=c or t
ggagcagttgcaccacaagcctccaagatgcaggangtgtccttggttaggcagagcacagtgctgtgatg

SEQ ID NO: 39375 - DNA, 71 bp, chicken (Gallus Gallus)
  misc_feature (36): n=a or g
aacgctgctgaatttgtctcaccgtattgaccagcngttaataaaaattactttatcagtattgcctttga

SEQ ID NO: 39376 - DNA, 71 bp, chicken (Gallus Gallus)
  misc_feature (36): n=a or g
ctggtgggtgatgcagaaagtcaaaaagtttccaancaattgagttaattccaagaagtccaagaagggtt

SEQ ID NO: 39377 - DNA, 71 bp, chicken (Gallus Gallus)
  misc_feature (36): n=a or g
caggcgctacttgtaagggagaattcaggatgcaantatctgtaggaatctaattttacctctttcaaaac

SEQ ID NO: 39378 - DNA, 71 bp, chicken (Gallus Gallus)
  misc_feature (36): n=g or t
tatcaaagtgttccagccgggatgtttgtactgctnataacaattaattaagtctgcaaaaggaggagctc

SEQ ID NO: 39379 - DNA, 71 bp, chicken (Gallus Gallus)
  misc_feature (36): n=a or g
tgctggttctccttccactgtggcttaccttaaacnttggtgtcagctgttgtgcccttggatggggcatg

SEQ ID NO: 39380 - DNA, 71 bp, chicken (Gallus Gallus)
  misc_feature (36): n=c or t
aagtatgtgcttgtgaacgaagcttaatcacgcatncatgttccaaaacaaaaagtcttttggataggtat

SEQ ID NO: 39381 - DNA, 71 bp, chicken (Gallus Gallus)
  misc_feature (36): n=a or g
caaaaagcagccactgggtagctgagaagctgtacntgtatgcataatgtgttattttttggtggtagcac

SEQ ID NO: 39382 - DNA, 71 bp, chicken (Gallus Gallus)
  misc_feature (36): n=a or g
tttcccttctcatagcacggttgttcctcagactcncggagtgctattgggtctatatgcaagtgtattaa

SEQ ID NO: 39383 - DNA, 71 bp, chicken (Gallus Gallus)
  misc_feature (36): n=a or g
ccgtaaagcacagccccactacacgcacagactaancagagcacaagcccccaaattccaacgtggtgatc

SEQ ID NO: 39384 - DNA, 71 bp, chicken (Gallus Gallus)
  misc_feature (36): n=a or g
gactagagtaggctgtattaccatgtaaagaaatcnagcaagaacatttgcaatactacacactttggtca

SEQ ID NO: 39385 - DNA, 71 bp, chicken (Gallus Gallus)
  misc_feature (36): n=c or t
tgcactaacgagatagagagatttctaacaacttangcttcctattcctagaaagcaactgccatataaca

SEQ ID NO: 39386 - DNA, 71 bp, chicken (Gallus Gallus)
  misc_feature (36): n=a or g
tttatcatggaggttgtgtatgtatggtactgaccntcacaccaatgtccagctcttcagtatgactcaga

SEQ ID NO: 39387 - DNA, 71 bp, chicken (Gallus Gallus)
  misc_feature (36): n=a or g
tgctcccccatcctcaccaacttaaaaatgcagcanggatatttctgcataaaatcattgttggttggttt

SEQ ID NO: 39388 - DNA, 71 bp, chicken (Gallus Gallus)
  misc_feature (36): n=c or t
caaatttttccttttacatggtgtgcatttgccatntcagtactaatttgtatcgcatgtttagatatttg

SEQ ID NO: 39389 - DNA, 71 bp, chicken (Gallus Gallus)
  misc_feature (36): n=c or t
agagataatgaacatccaccagtgtttcctttctcnggtagaatgacgtctaagtggctgggcaaacaaca

SEQ ID NO: 39390 - DNA, 71 bp, chicken (Gallus Gallus)
  misc_feature (36): n=g or t
ccctcgcatggaatacccacaaccaaagtacacaanatctagtaccttctctcatcacaggtgatggaaat

SEQ ID NO: 39391 - DNA, 71 bp, chicken (Gallus Gallus)
  misc_feature (36): n=a or g
tgtggatgtaaccaagagatcttgcttgagctgaantaggttttgacacccctcatgttgtgcatgtcagg

SEQ ID NO: 39392 - DNA, 71 bp, chicken (Gallus Gallus)
  misc_feature (36): n=c or t
tctggttctttggacccgaagtaggcctccgtctcngtcggtgggatgcccatcctctgcatgtagatgtt

SEQ ID NO: 39393 - DNA, 71 bp, chicken (Gallus Gallus)
  misc_feature (36): n=g or t
ccagggctctgcactgcccctgtcaccaaacggggnggcctaccttgcttgaaatacatgaaatgacccct

SEQ ID NO: 39394 - DNA, 71 bp, chicken (Gallus Gallus)
  misc_feature (36): n=a or g
agaaaacttgtgaactcttcagatctaattccaccnaccgctttcccagcatcccttgtccacagattacc

SEQ ID NO: 39395 - DNA, 71 bp, chicken (Gallus Gallus)
  misc_feature (36): n=a or c
cagccagaattcagccttggagggaaaaccatcacnaaatgcccgatttcctgctcgctgagctgagcagc

SEQ ID NO: 39396 - DNA, 71 bp, chicken (Gallus Gallus)
  misc_feature (36): n=c or t
cacatgcaaaacacccctgcaccactgagtcatgcnggcatgaccacgctgtctggctcagagctactcac

SEQ ID NO: 39397 - DNA, 71 bp, chicken (Gallus Gallus)
  misc_feature (36): n=a or g
tgaactgcagccaaggtctgctgctcagcaccccangttcacatacaacgatatgtgccgaatcacagagg

SEQ ID NO: 39398 - DNA, 71 bp, chicken (Gallus Gallus)
  misc_feature (36): n=a or g
agccgctccttgcttgtgcttttaattaggagaagncaacgtgataacatgcatatctcagtgagggggtg

SEQ ID NO: 39399 - DNA, 71 bp, chicken (Gallus Gallus)
  misc_feature (36): n=a or c
tccagggaagccatgtgtctcccatggaaaaagacngaaagaaatcctgtccttttgtggtctgatttctg

SEQ ID NO: 39400 - DNA, 71 bp, chicken (Gallus Gallus)
  misc_feature (36): n=a or g
aagccgtgccacaaacactgcagcaacgcctggccnggcagttggctttgatcccttgtgtaggcatctct

SEQ ID NO: 39401 - DNA, 71 bp, chicken (Gallus Gallus)
  misc_feature (36): n=c or t
gattctcaaacagatcataatcaatgccgacttctngctttcaaagtttgccagagccaaccaagcactat

SEQ ID NO: 39402 - DNA, 71 bp, chicken (Gallus Gallus)
  misc_feature (36): n=a or c
gagtcatttttggccgccttcaagtgaaattgagangcaggaggaggcagatctcagagcctgcgtgtgct

SEQ ID NO: 39403 - DNA, 71 bp, chicken (Gallus Gallus)
  misc_feature (36): n=a or g
actgcattgctcgtgcattccttcttcatcactgantgaatcagtgcagcgtggcattttcagggcactca

SEQ ID NO: 39404 - DNA, 71 bp, chicken (Gallus Gallus)
  misc_feature (36): n=c or t
actgcatagaactgtccctaaaaagacatttctgcnctgcccaatggctgcctgtggcttaaggcactttt

SEQ ID NO: 39405 - DNA, 71 bp, chicken (Gallus Gallus)
  misc_feature (36): n=g or t
taccttcctgctagtcatcttcatctgggtacaaantaatctaaggagaacccagctgagacaaaggcagg

SEQ ID NO: 39406 - DNA, 71 bp, chicken (Gallus Gallus)
  misc_feature (36): n=c or t
caagcagaccagccacttgcttcaaagctaatccangtgacactttccctgtaagaaacaaaccctgcttg

SEQ ID NO: 39407 - DNA, 71 bp, chicken (Gallus Gallus)
  misc_feature (36): n=c or t
gcactctgcaaatcacagcctggactaagcctggtnccgttcagccagctcctcctcatccccttctatca

SEQ ID NO: 39408 - DNA, 71 bp, chicken (Gallus Gallus)
  misc_feature (36): n=a or g
aactctgtctccacagtcacttccacacaacagccntgttagctttagcaagactaattccatctgcatga

SEQ ID NO: 39409 - DNA, 71 bp, chicken (Gallus Gallus)
  misc_feature (36): n=c or t
gtgcccactcccagagctcatacccagacaggagtncaaatgagtggaataaatgattcctgtgttcgcca

SEQ ID NO: 39410 - DNA, 71 bp, chicken (Gallus Gallus)
  misc_feature (36): n=a or g
gacaggggatttctgtgctcaacagctggctcagcncacagatttcttttgctaaatagcatagttatggg

SEQ ID NO: 39411 - DNA, 71 bp, chicken (Gallus Gallus)
  misc_feature (36): n=c or t
agtttggtgcctgctgccatcagcgtggtaccttgngtcaatggggccagggggccagcagtgccaccggt

SEQ ID NO: 39412 - DNA, 71 bp, chicken (Gallus Gallus)
  misc_feature (36): n=c or t
cccatccgtggggctctcaggtcagaacaaccaacncattttccttccaagctctctgcccgttggtttcc

SEQ ID NO: 39413 - DNA, 71 bp, chicken (Gallus Gallus)
  misc_feature (36): n=a or g
cagcaacgcagaaggagattacccaccctctcatgngaggtgagacacttgcaatgaaagctccaggagag

SEQ ID NO: 39414 - DNA, 71 bp, chicken (Gallus Gallus)
  misc_feature (36): n=a or g
gtgagtcttatatatactgtaagttactttcaaacnggcctttagctcgctgttaagtcccaaaggaagca

SEQ ID NO: 39415 - DNA, 71 bp, chicken (Gallus Gallus)
  misc_feature (36): n=g or t
accatatcttagactcgtgctttgagtccttacagnaagcacaggctaatgtttaaaatgcttttgcattc

SEQ ID NO: 39416 - DNA, 71 bp, chicken (Gallus Gallus)
  misc_feature (36): n=a or g
agatttgctgttccaaagtctagggctgcagggtgnctggctgagctggtgctgatgctcggcgctggggg

SEQ ID NO: 39417 - DNA, 71 bp, chicken (Gallus Gallus)
  misc_feature (36): n=c or t
ccagcaatgggaaaggagtgaggacagctctgtgtntctcctgctgtcactcacccggtgtttgcgtgcat

SEQ ID NO: 39418 - DNA, 71 bp, chicken (Gallus Gallus)
  misc_feature (36): n=a or g
ctaattttggagatcagaacactttgctttcataanttcctaatgccagttccagattttaagttgtgctg

SEQ ID NO: 39419 - DNA, 71 bp, chicken (Gallus Gallus)
  misc_feature (36): n=a or g
gagtcagaactaatttggttgttcagtagtcttggnaaagatggttttatggccatgagtctttattacag

SEQ ID NO: 39420 - DNA, 71 bp, chicken (Gallus Gallus)
  misc_feature (36): n=c or t
aaatagacctccttaaagctggtagctgcactagtntgtagctggtccaagcaggacagcaagctccttta

SEQ ID NO: 39421 - DNA, 71 bp, chicken (Gallus Gallus)
  misc_feature (36): n=c or t
ttgtctgctcatggccaagtttagaaaggcacagcnggacctctgcttaatgtggcctctgttattctctt

SEQ ID NO: 39422 - DNA, 71 bp, chicken (Gallus Gallus)
  misc_feature (36): n=a or g
gcagctcctgggtgctcagctgaggatatttgttanaaggaataagaaaggagctcgagcctgcagggggg

SEQ ID NO: 39423 - DNA, 71 bp, chicken (Gallus Gallus)
  misc_feature (36): n=c or t
tctttagaaggtgtgaattaggtgagcttgtgaacngggttggcactgagagaaagaatggaaggctatgg

SEQ ID NO: 39424 - DNA, 71 bp, chicken (Gallus Gallus)
  misc_feature (36): n=c or t
aaacggaggtttactaagccagccagagaccacagngttggagcaaaagagcccatctagaaggcaaaaga

SEQ ID NO: 39425 - DNA, 71 bp, chicken (Gallus Gallus)
  misc_feature (36): n=c or t
gcacatcatggacttactgctattcaataccttganggctatagctgactagccagaaatctttttagaaa

SEQ ID NO: 39426 - DNA, 71 bp, chicken (Gallus Gallus)
  misc_feature (36): n=c or t
tatgtttaaggaccacaagaggcacaggtgcaacgngaggctttatctgggggctgtgctaagggtctcac

SEQ ID NO: 39427 - DNA, 71 bp, chicken (Gallus Gallus)
  misc_feature (36): n=a or g
tactcagtgaaaaagaaccaagaaataccaaccagntaaatacgtatcaacaatgacccagaatgcagtct

SEQ ID NO: 39428 - DNA, 71 bp, chicken (Gallus Gallus)
  misc_feature (36): n=c or t
caagtgcccatatccctgctgcattgccagagctcncaatgggactgcattcactcccaccgaggtgcata

SEQ ID NO: 39429 - DNA, 71 bp, chicken (Gallus Gallus)
  misc_feature (36): n=c or t
tcttcaaaggacagccaacgctgagctgatgggagngaaacttcatgggcatcggagatggggtcggggat

SEQ ID NO: 39430 - DNA, 71 bp, chicken (Gallus Gallus)
  misc_feature (36): n=a or g
attcggcgctatgggaacggccatccaaagggaacncagttattccctctgcactttcttcaataaatgaa

SEQ ID NO: 39431 - DNA, 71 bp, chicken (Gallus Gallus)
  misc_feature (36): n=a or c
gcagtttcactcccatttggcctccactcacaaacncagcagagaaatgctctgtgagatgctcaaacacg

SEQ ID NO: 39432 - DNA, 71 bp, chicken (Gallus Gallus)
  misc_feature (36): n=a or c
ttaagcctgttttagaatagcattactcagttttanattactttaataccttcagtgcagttttcccagtt

SEQ ID NO: 39433 - DNA, 71 bp, chicken (Gallus Gallus)
  misc_feature (36): n=a or c
cccagtgtttattcaagcaaataaagttaataaatnctgttaaaatgttactagagttttgctgctctgtt

SEQ ID NO: 39434 - DNA, 71 bp, chicken (Gallus Gallus)
  misc_feature (36): n=c or t
gcaggtgcccctctctatgaaactggccaacgaccnactcacaaatttgctgtgcttgttaatattaaaat

SEQ ID NO: 39435 - DNA, 71 bp, chicken (Gallus Gallus)
  misc_feature (36): n=a or g
acatcattaagtatccctgtgttttggaaaactcanacatatgaatcttcatgttacagagcagattatca

SEQ ID NO: 39436 - DNA, 71 bp, chicken (Gallus Gallus)
  misc_feature (36): n=a or c
tgggagccattggggcatttttaaaaggagctgaanaagacagtaagtacagcattgctatgttctgtata

SEQ ID NO: 39437 - DNA, 71 bp, chicken (Gallus Gallus)
  misc_feature (36): n=c or t
caggctccccagcaactcacactggggatgcagtgngatccaaccagctgactgttgtacagaagtcactg

SEQ ID NO: 39438 - DNA, 71 bp, chicken (Gallus Gallus)
  misc_feature (36): n=a or g
aaacatgccattgcatcagatcataatcagctcacntataataatcagaacaccttcagtaactaataatg

SEQ ID NO: 39439 - DNA, 71 bp, chicken (Gallus Gallus)
  misc_feature (36): n=a or c
atgcctacaaacaaaacataatcattaaacaagatncagacaaaacaatcttagtaattccagctaggatt

SEQ ID NO: 39440 - DNA, 71 bp, chicken (Gallus Gallus)
  misc_feature (36): n=a or g
tgctttactattttgttaacatgagctaaaaaactntgagctgactggataataggtgaaatgataatatt

SEQ ID NO: 39441 - DNA, 71 bp, chicken (Gallus Gallus)
  misc_feature (36): n=a or g
tccacaaatcaacttggccattcagggtttttggtnaatttgtatttttccaagtaaatctctatcagtta

SEQ ID NO: 39442 - DNA, 71 bp, chicken (Gallus Gallus)
  misc_feature (36): n=g or t
tgcacagactcataccaagtacagacctaactttcnagcccagcgtttaccaaattttcttggggatacac

SEQ ID NO: 39443 - DNA, 71 bp, chicken (Gallus Gallus)
  misc_feature (36): n=a or g
gatggtccttcccagcatcacacgagttcagctgcnaatctttccaggatctctagcatgccacaaacctg

SEQ ID NO: 39444 - DNA, 71 bp, chicken (Gallus Gallus)
  misc_feature (36): n=c or t
gacatgcctgtccttgcagcaggatgcctgcctacnctcaagccctattttgggaacgcaagtgggatggg

SEQ ID NO: 39445 - DNA, 71 bp, chicken (Gallus Gallus)
  misc_feature (36): n=a or g
tataagctgtcttttgacagttgctgctttgcatancattctttgcataacattaaataacttgagagtat

SEQ ID NO: 39446 - DNA, 71 bp, chicken (Gallus Gallus)
  misc_feature (36): n=g or t
aaggatttcttttctgtcaggattattggtcagaanagtgcattgggggaagaaacaggcaacagaagtgt

SEQ ID NO: 39447 - DNA, 71 bp, chicken (Gallus Gallus)
  misc_feature (36): n=a or c
gcttctaatttgtagatccttctagtaattgttgcnggctctattacagattaaaggggttacaagatttg

SEQ ID NO: 39448 - DNA, 71 bp, chicken (Gallus Gallus)
  misc_feature (36): n=a or g
cttatcagggcatttatcagccctcattttgtagcngagtgaaatcttcgaacatgtttcttcttctgttg

SEQ ID NO: 39449 - DNA, 71 bp, chicken (Gallus Gallus)
  misc_feature (36): n=a or g
gaggggaaaaaagcttctattaggtcatcctgtccntctcttctgccagttcagaacagctccctgcatgt

SEQ ID NO: 39450 - DNA, 71 bp, chicken (Gallus Gallus)
  misc_feature (36): n=a or c
gggcacattaccacatgggttaattttcctaacttntcagtgctgtatgagtacactgcaagtgtgcagca

SEQ ID NO: 39451 - DNA, 71 bp, chicken (Gallus Gallus)
  misc_feature (36): n=c or t
ctgtaagggaagggataaaggcagagctgttcagtnggaggcctttagaaaacatagcattgggacataaa

SEQ ID NO: 39452 - DNA, 71 bp, chicken (Gallus Gallus)
  misc_feature (36): n=c or t
gaccattcacttgcacagatgatcctccttagccangagtacccagaagtgggagaggattcaaattaagt

SEQ ID NO: 39453 - DNA, 71 bp, chicken (Gallus Gallus)
  misc_feature (36): n=c or t
aagaaatagataggttgtaaatatttctgacttagngtcttcacaaatatgaagttcgagcacacagaaaa

SEQ ID NO: 39454 - DNA, 71 bp, chicken (Gallus Gallus)
  misc_feature (36): n=a or g
acatttggttcagtttccagacatgcagagaacacntaaaggcactaacaattgcctgatagggaaatacg

SEQ ID NO: 39455 - DNA, 71 bp, chicken (Gallus Gallus)
  misc_feature (36): n=a or c
ctggtgagttgttgcacattgtgcagccataaaagnaccagtgacagtcagagaaggtgacaggaacagta

SEQ ID NO: 39456 - DNA, 71 bp, chicken (Gallus Gallus)
  misc_feature (36): n=a or g
cagattaagtagttaaagattcacatatacaacacnttttgactttccaaatttcaccaggatacacagtg

SEQ ID NO: 39457 - DNA, 71 bp, chicken (Gallus Gallus)
  misc_feature (36): n=a or g
aaactgccaatcagaaaccgtgtgtgcatcaggacngccctcgcttacgagcacagacaaaaaatagataa

SEQ ID NO: 39458 - DNA, 71 bp, chicken (Gallus Gallus)
  misc_feature (36): n=g or t
agtatgtgtggtgaaaaggaatgtgaagagcagttngagctagtgcttaaaatcaggctgttagtggtgct

SEQ ID NO: 39459 - DNA, 71 bp, chicken (Gallus Gallus)
  misc_feature (36): n=a or g
ttgccaaagtaggataactgattaaacaaaaatgantttaatgctaatcagacttctgtggcaggtattag

SEQ ID NO: 39460 - DNA, 71 bp, chicken (Gallus Gallus)
  misc_feature (36): n=c or t
tcctagcagaaggaggcaatgttgccaaggaaattnttctccataaacgtttgctacagcatgaaaaggag

SEQ ID NO: 39461 - DNA, 71 bp, chicken (Gallus Gallus)
  misc_feature (36): n=a or g
ggtcacagagggtgccccatgctcagctggatggangacctatgaattctgatttgtcagtctagcatttt

SEQ ID NO: 39462 - DNA, 71 bp, chicken (Gallus Gallus)
  misc_feature (36): n=c or t
ggttcagtgagtgaggaaacgcaatgcaataaggangtctcttggaatcacacaccatttagccagctcag

SEQ ID NO: 39463 - DNA, 71 bp, chicken (Gallus Gallus)
  misc_feature (36): n=c or t
gtgcaggatgtaaccattattgaatctactcatttnattatctcttgcaattaaatgaatgactactgaat

SEQ ID NO: 39464 - DNA, 71 bp, chicken (Gallus Gallus)
  misc_feature (36): n=a or g
acttactttccatcaataagtaatgaagttttagtntgtgagtgctgttgtgattccatcttgtgaatatc

SEQ ID NO: 39465 - DNA, 71 bp, chicken (Gallus Gallus)
  misc_feature (36): n=c or t
gcttgtgggcaggctgaatctatataggttaatatngagagctcagagatttcttactgacttgaatattc

SEQ ID NO: 39466 - DNA, 71 bp, chicken (Gallus Gallus)
  misc_feature (36): n=a or g
tctaactctattctgttgcaggatgctaggaaagcntgtgcagatgccaccttggctcaggtaagcagtta

SEQ ID NO: 39467 - DNA, 71 bp, chicken (Gallus Gallus)
  misc_feature (36): n=a or g
taatctcaggttggggtgtctttgtacctttcaggngattcagttaacctcacaggcactcctctgcttaa

SEQ ID NO: 39468 - DNA, 71 bp, chicken (Gallus Gallus)
  misc_feature (36): n=a or g
tggaggcttatcagcagaatgcacaagcagagctgnaagagaagaggcaaagatttgctaaaattcttagt

SEQ ID NO: 39469 - DNA, 71 bp, chicken (Gallus Gallus)
  misc_feature (36): n=c or t
acagaggtcgtgctgccttcatacagggagaggttngtgtgcctacagctgagggcgaatgctgaagctgg

SEQ ID NO: 39470 - DNA, 71 bp, chicken (Gallus Gallus)
  misc_feature (36): n=c or t
atctcgttgggacctcatggacctgattgctgcttnctgaaactgggaggatgtagctgtgcacaaggaga

SEQ ID NO: 39471 - DNA, 71 bp, chicken (Gallus Gallus)
  misc_feature (36): n=c or t
gcaagacagtaagggctatgcagggagatggaatcnttccttaaaagctgtcaaactggctgtcagcgtgt

SEQ ID NO: 39472 - DNA, 71 bp, chicken (Gallus Gallus)
  misc_feature (36): n=g or t
agttgttaatgttttcaagacttttgtaatcaaaancagttaacagtgcttccattcctgctgtgtaatgg

SEQ ID NO: 39473 - DNA, 71 bp, chicken (Gallus Gallus)
  misc_feature (36): n=a or g
acagcttctattactttcttgtccagctctctttcnaagcatttgtccaaggggtttcagggcctcttaac

SEQ ID NO: 39474 - DNA, 71 bp, chicken (Gallus Gallus)
  misc_feature (36): n=a or g
aactgttggatatccagaataaagtctgcttaaacntttgcacgttactcaaggttagaacactcatgtat

SEQ ID NO: 39475 - DNA, 71 bp, chicken (Gallus Gallus)
  misc_feature (36): n=a or g
aggatatttttctaaggttctctgttgaaagaatcngaagcagcaaacatatgtaatgtcttctgcttaga

SEQ ID NO: 39476 - DNA, 71 bp, chicken (Gallus Gallus)
  misc_feature (36): n=a or c
ctacaaattacagtgcttaaccaacgatccatcttncatttagacccaggtggagctgaataggaaaatga

SEQ ID NO: 39477 - DNA, 71 bp, chicken (Gallus Gallus)
  misc_feature (36): n=a or g
ttttttcttgtttgtctgcagatctacagattatcnctctaataatgatttatagttctgcaaacactgca

SEQ ID NO: 39478 - DNA, 71 bp, chicken (Gallus Gallus)
  misc_feature (36): n=a or g
tgggaagagctgttcccttttcctttgattgtagcntggtatgatatgtttcacatttagagaagatgtag

SEQ ID NO: 39479 - DNA, 71 bp, chicken (Gallus Gallus)
  misc_feature (36): n=a or g
ggtactgttaaaaaaacaatatgcttgttagaactnaggaaagctggtactgtcttgctcttgaacgttgc

SEQ ID NO: 39480 - DNA, 71 bp, chicken (Gallus Gallus)
  misc_feature (36): n=a or g
tgggaacatccttcacgttcctgattccttatagancagctcaataaacaactccgacaacaaaaccctat

SEQ ID NO: 39481 - DNA, 71 bp, chicken (Gallus Gallus)
  misc_feature (36): n=a or g
tccctatgaagagacaggagctgaggcacatcagcntgagtgcaaacaaggcaaagaggttcaggttgccc

SEQ ID NO: 39482 - DNA, 71 bp, chicken (Gallus Gallus)
  misc_feature (36): n=a or g
ctgcgggattctccctcagacactcatgtcttcctnaagtaacagttgtgctttttcaggctctgaagaag

SEQ ID NO: 39483 - DNA, 71 bp, chicken (Gallus Gallus)
  misc_feature (36): n=c or t
caggcctgcagggtagcaacagagggtgggcacatnctatgaactaggaataaaacttcaacctgtaacca

SEQ ID NO: 39484 - DNA, 71 bp, chicken (Gallus Gallus)
  misc_feature (36): n=a or g
aaagaagatcattattgctaatgatacagccagccngtttggaatctggtctccttttcaagctctatcaa

SEQ ID NO: 39485 - DNA, 71 bp, chicken (Gallus Gallus)
  misc_feature (36): n=c or t
cacctgtcagggctcctttgcaatatccgaaattgntgggagaagggagttgggctcataacgctgcacgg

SEQ ID NO: 39486 - DNA, 71 bp, chicken (Gallus Gallus)
  misc_feature (36): n=c or t
actgctttgggggggctctgacagcaacttgagctncccatcacctgtaggtgggttgatttgtaaagcca

SEQ ID NO: 39487 - DNA, 71 bp, chicken (Gallus Gallus)
  misc_feature (36): n=a or g
tttgtttcattgttttaattcaagtaatatcgacantaaagaaactcagcatgaatctcaactattttctt

SEQ ID NO: 39488 - DNA, 71 bp, chicken (Gallus Gallus)
  misc_feature (36): n=a or g
tgggctggtgcaggaccacttaaggaggaaaatttnggactcatggctggaacagaagtctaggaaactct

SEQ ID NO: 39489 - DNA, 71 bp, chicken (Gallus Gallus)
  misc_feature (36): n=a or g
agtgtagtcaccgtgcactgaattcttgtctgaacnatttgtttggcagggggttctgacggggagccccc

SEQ ID NO: 39490 - DNA, 71 bp, chicken (Gallus Gallus)
  misc_feature (36): n=c or t
agggcacaaacatcacgcaggcaaatactgaagcanatgtgtatagacctagagctccaaatcagttgcac

SEQ ID NO: 39491 - DNA, 71 bp, chicken (Gallus Gallus)
  misc_feature (36): n=a or g
gtcctctgtataagaaaagctggctgctgcacttgnagtgatcattaggggactgcaggcagtgctcgttt

SEQ ID NO: 39492 - DNA, 71 bp, chicken (Gallus Gallus)
  misc_feature (36): n=c or t
aaacaaacacaaggctttctttacctcttgtagctnagttgtatctaagatagttctcactgaggtcctag

SEQ ID NO: 39493 - DNA, 71 bp, chicken (Gallus Gallus)
  misc_feature (36): n=g or t
agtccttccccagacaaacacctctctcttccttantgaccccagcacttaggacagccgggacagcacag

SEQ ID NO: 39494 - DNA, 71 bp, chicken (Gallus Gallus)
  misc_feature (36): n=c or t
aagaatgttttacaaaaggaaccatttatttctaangggaccatagctttcctgtgtccgcattgggtaga

SEQ ID NO: 39495 - DNA, 71 bp, chicken (Gallus Gallus)
  misc_feature (36): n=a or g
gctgaactaagaggttataaccagaggaacccgaangatttatttataccctgtattttgtgagcctaacc

SEQ ID NO: 39496 - DNA, 71 bp, chicken (Gallus Gallus)
  misc_feature (36): n=a or g
gagcagcagacaccgcttttgccacgcatcaacccntgctatgctgacgtcctcagcagtcacttccacca

SEQ ID NO: 39497 - DNA, 71 bp, chicken (Gallus Gallus)
  misc_feature (36): n=a or g
ctgcatttgtgcactctcagaagaatttagaagccnaagttaataaatagctttccaaatacagcatttta

SEQ ID NO: 39498 - DNA, 71 bp, chicken (Gallus Gallus)
  misc_feature (36): n=g or t
accctgaactagccacttagatattgcaaagccagntgcacgaccctgccctgcgctgcacggcgctctgt

SEQ ID NO: 39499 - DNA, 71 bp, chicken (Gallus Gallus)
  misc_feature (36): n=a or c
tctcaccatccctctagaaaacccttcattaagaanagataaagtcaatcacttacttgttctctcccgcc

SEQ ID NO: 39500 - DNA, 71 bp, chicken (Gallus Gallus)
  misc_feature (36): n=c or t
agtcaaggggagcgagggctcgcaaacagagctctnggaagatgcgcaagcatgtatgtctgaagtagttc

SEQ ID NO: 39501 - DNA, 71 bp, chicken (Gallus Gallus)
  misc_feature (36): n=c or t
agaactggatgtagtctgccatcagcatcttttcangagttcatttctccgttaacatttggcacaagctc

SEQ ID NO: 39502 - DNA, 71 bp, chicken (Gallus Gallus)
  misc_feature (36): n=a or c
atataaagaagctccaatagaataacggcatcttcngccagctaccagaagagactggcacagtgacacgc

SEQ ID NO: 39503 - DNA, 71 bp, chicken (Gallus Gallus)
  misc_feature (36): n=c or t
tgacagcacaatcacgaagcgttactgaagtctatncgctaataagtcatatttctcaactgcctaaaatc

SEQ ID NO: 39504 - DNA, 71 bp, chicken (Gallus Gallus)
  misc_feature (36): n=a or g
aacataggagtgtctctgcagctcaaatccatgtcngaaaggatttgggggcagtcaggcctagagatgaa

SEQ ID NO: 39505 - DNA, 71 bp, chicken (Gallus Gallus)
  misc_feature (36): n=c or t
tacaatggtaaggcaaataaatatccacctggaaanaccactgtgagaactaaacctatggatccttctga

SEQ ID NO: 39506 - DNA, 71 bp, chicken (Gallus Gallus)
  misc_feature (36): n=a or c
catccgcttgctgctggaaggatatcttcacagcancagcttaagtgtgttcttggaaacagtggctcact

SEQ ID NO: 39507 - DNA, 71 bp, chicken (Gallus Gallus)
  misc_feature (36): n=c or t
ctcccagcatcccaaatctctccctgtttatgtagnatctcccctacagcaccgggcacaccttaaaacaa

SEQ ID NO: 39508 - DNA, 71 bp, chicken (Gallus Gallus)
  misc_feature (36): n=c or t
acaagcgacgttgccacgctatctcagagatgcagncaagtggattacagggattagggatgggttttgaa

SEQ ID NO: 39509 - DNA, 71 bp, chicken (Gallus Gallus)
  misc_feature (36): n=a or g
cactgcactcatgagagcgtgtttgtctcagagatncacactgaaaaggtcaagaaatgtcacagtctcct

SEQ ID NO: 39510 - DNA, 71 bp, chicken (Gallus Gallus)
  misc_feature (36): n=c or t
aaaagaagcagaaaaccctgcaaatgcagaccctcnttttgtggtggatgcaattctcatcactgggtgat

SEQ ID NO: 39511 - DNA, 71 bp, chicken (Gallus Gallus)
  misc_feature (36): n=c or t
gtctccaggagttcatgagagttttcttctgcctantgcagatgtttttgctctcattaaacaagctaaaa

SEQ ID NO: 39512 - DNA, 71 bp, chicken (Gallus Gallus)
  misc_feature (36): n=a or g
ggcgcaaggagagtcaccatcatcactggtgtgctncagaggcaggtgaggggtaatttccactggagaat

SEQ ID NO: 39513 - DNA, 71 bp, chicken (Gallus Gallus)
  misc_feature (36): n=a or g
tgaaagacataaccattgggtttttggggcatgatnatagatcaagagttgacttccacgggttggggtag

SEQ ID NO: 39514 - DNA, 71 bp, chicken (Gallus Gallus)
  misc_feature (36): n=c or t
agatcacaaaatagatcactgggtcagggaggctcnggcaatttgccttcatgggaaacaagctgcaggaa

SEQ ID NO: 39515 - DNA, 71 bp, chicken (Gallus Gallus)
  misc_feature (36): n=a or g
tgctgctgctgaatttccccctctgcaagcattagngaacgaggctggaagaccaaggtcgcatcctgctg

SEQ ID NO: 39516 - DNA, 71 bp, chicken (Gallus Gallus)
  misc_feature (36): n=a or g
aaggttgtgttgagctgggtggtcccatcacatagnatgggactgaagtgagcacgccacaaaggcagcag

SEQ ID NO: 39517 - DNA, 71 bp, chicken (Gallus Gallus)
  misc_feature (36): n=c or t
gtttgtgtgttagcagtttcttgtgattacatttancctcttgcagataagcacagaagaaagggtgctct

SEQ ID NO: 39518 - DNA, 71 bp, chicken (Gallus Gallus)
  misc_feature (36): n=c or t
gcagtgctgccttattccggttgctttactttggtntgcacctggctggaagctgcatggggataagtggc

SEQ ID NO: 39519 - DNA, 71 bp, chicken (Gallus Gallus)
  misc_feature (36): n=a or c
cacattatactgttaaatcagagcctctcgctttanccccatcgcatcctcccggcgtgctccaaaggctg

SEQ ID NO: 39520 - DNA, 71 bp, chicken (Gallus Gallus)
  misc_feature (36): n=a or g
gcagctccgtcccagcgctcgtaggaaacttgaacngagagaactgatagttttctatcagctgccatccc

SEQ ID NO: 39521 - DNA, 71 bp, chicken (Gallus Gallus)
  misc_feature (36): n=a or g
ttccccaaaataactcactgaaatataatggtacanggaaaccaacaagcctaacaacctcaaaaatacac

SEQ ID NO: 39522 - DNA, 71 bp, chicken (Gallus Gallus)
  misc_feature (36): n=a or g
actctgcccatctttcagtctgaggttgcaaagacngaagcggagatttgaagccaggtcctcaggcaatg

SEQ ID NO: 39523 - DNA, 71 bp, chicken (Gallus Gallus)
  misc_feature (36): n=a or g
aggactggttttctaaccctctgtaggggccctgcntagggaattagtcatggaggtgagtaatccccact

SEQ ID NO: 39524 - DNA, 71 bp, chicken (Gallus Gallus)
  misc_feature (36): n=a or g
gggtcactcccacccaatgctgggtgggatgctgcngtacagagagagcagggatcaggactcccaccaaa

SEQ ID NO: 39525 - DNA, 71 bp, chicken (Gallus Gallus)
  misc_feature (36): n=a or g
ttgccaaacagtcttaattgttaaagcaacaactcnaggctttcaatttctacaagaacaagaaatccacc

SEQ ID NO: 39526 - DNA, 71 bp, chicken (Gallus Gallus)
  misc_feature (36): n=a or g
acgccagacttattttccttcatgtcaaacagcccnaagcttcagtgtgctcattctgtagtactgagagg

SEQ ID NO: 39527 - DNA, 71 bp, chicken (Gallus Gallus)
  misc_feature (36): n=a or g
tcaggtgtaggaaataagcttcactctgctacaagngaactacacagtgcaaaagcagaaggtgctgagga

SEQ ID NO: 39528 - DNA, 71 bp, chicken (Gallus Gallus)
  misc_feature (36): n=c or t
agaaggcaaaagctgagaagtatgacctaagaaaanagattttcatctcttggttgaatggagtaaggaag

SEQ ID NO: 39529 - DNA, 71 bp, chicken (Gallus Gallus)
  misc_feature (36): n=c or t
ttactgatacagttcaggctggagcttgaatctctngggcatttcctgaatgaaccaatcatccaggtaag

SEQ ID NO: 39530 - DNA, 71 bp, chicken (Gallus Gallus)
  misc_feature (36): n=g or t
gggctgaaaaaatatctccttggtccttaaactcanatttgctgcttcccaacacgccacctgcagcaaca

SEQ ID NO: 39531 - DNA, 71 bp, chicken (Gallus Gallus)
  misc_feature (36): n=a or g
caaatattctgtgagcagagtagtattttcttaganttcagcacaacaggatgaaagcaatggtacaaaat

SEQ ID NO: 39532 - DNA, 71 bp, chicken (Gallus Gallus)
  misc_feature (36): n=a or g
ggctatgaattcactaacacattcactgcctggaantcctgacacacccaatggaatgcactttcacattt

SEQ ID NO: 39533 - DNA, 71 bp, chicken (Gallus Gallus)
  misc_feature (36): n=c or t
gagaaagtcaccccggtcactgtgacttacagccangacagagatggcatcaaaattgctgctcggcctta

SEQ ID NO: 39534 - DNA, 71 bp, chicken (Gallus Gallus)
  misc_feature (36): n=a or g
cccccatggagctgacagagaatttcctgagccagngctttacctttgacatgcccaaggatgctggtaag

SEQ ID NO: 39535 - DNA, 71 bp, chicken (Gallus Gallus)
  misc_feature (36): n=c or t
tatgacagcagaatgctttgagtatttgccaaccangagagccaggcagcgtcatccctaaggtgcccatc

SEQ ID NO: 39536 - DNA, 71 bp, chicken (Gallus Gallus)
  misc_feature (36): n=c or t
ctgcattcatgcaagttaagacaagaacccttacantgcagctgctcatggctcaagccctgctggttttc

SEQ ID NO: 39537 - DNA, 71 bp, chicken (Gallus Gallus)
  misc_feature (36): n=g or t
ccacactcatgacctcacctaaacttctaaaatcanatagaagggaatatctgacatttagattggagtct

SEQ ID NO: 39538 - DNA, 71 bp, chicken (Gallus Gallus)
  misc_feature (36): n=c or t
tattacaaaacaattacatctgacaagtcactctcnagcaagctcagctacaccctgccaggctccactca

SEQ ID NO: 39539 - DNA, 71 bp, chicken (Gallus Gallus)
  misc_feature (36): n=c or t
caacagctcctccaccccctgcattccccatcactngacattctgcagtgcaagagccaagtggaagaatc

SEQ ID NO: 39540 - DNA, 71 bp, chicken (Gallus Gallus)
  misc_feature (36): n=a or g
tcatcccaaacactgcgccaatccactgctgcaacncagtccattaatagtaacacagttatgcatcgcag

SEQ ID NO: 39541 - DNA, 71 bp, chicken (Gallus Gallus)
  misc_feature (36): n=c or t
tcctcctcttttatgaaaaaatactgcaggtttccnacagttgaagctctgaccaatttgttcgctgcctt

SEQ ID NO: 39542 - DNA, 71 bp, chicken (Gallus Gallus)
  misc_feature (36): n=c or t
agaatagaaggtgatttttcatacacactctgatgntcttatttgaattacaaaatagtcattaaaaatgc

SEQ ID NO: 39543 - DNA, 71 bp, chicken (Gallus Gallus)
  misc_feature (36): n=a or g
acccagcaatgcagtgataaatggtgttgactgcangagtaattttcattacttttaccacctcatttaat

SEQ ID NO: 39544 - DNA, 71 bp, chicken (Gallus Gallus)
  misc_feature (36): n=a or c
cagggctgtgggaagctgcaggttttgaacatgcangtggaagttgtgggggtttttgtggttggaccagc

SEQ ID NO: 39545 - DNA, 71 bp, chicken (Gallus Gallus)
  misc_feature (36): n=a or g
actctgtagtttgtagcatcctttggagtgatgctntgaactcttttgaatgccctcaaaaccagaagagt

SEQ ID NO: 39546 - DNA, 71 bp, chicken (Gallus Gallus)
  misc_feature (36): n=c or t
ggcagtactcagtcctgaagtgtaccaagagtaccntgtaaagcctcatatgggaccaaagctatcaagta

SEQ ID NO: 39547 - DNA, 71 bp, chicken (Gallus Gallus)
  misc_feature (36): n=g or t
gccccgtgtgcttcagggaaaggcaggcctgtgctntaggtcagtatggtgcagaacgagagattaatttt

SEQ ID NO: 39548 - DNA, 71 bp, chicken (Gallus Gallus)
  misc_feature (36): n=a or g
tttgttgttgttgtttttaccttttttccagcaaanagctctactttcagtatcaatacccatcagccaac

SEQ ID NO: 39549 - DNA, 71 bp, chicken (Gallus Gallus)
  misc_feature (36): n=c or t
caggaggggaaaatggggaggtacttaatgaacctntcttcctttgtaacgctgcatagatctgcgccagg

SEQ ID NO: 39550 - DNA, 71 bp, chicken (Gallus Gallus)
  misc_feature (36): n=c or t
tctttcagtatgattacatgagtaacacattaaggntgcacgtttttcttgtgattttctaaaaattcaga

SEQ ID NO: 39551 - DNA, 71 bp, chicken (Gallus Gallus)
  misc_feature (36): n=c or t
caacatctgaaaatattctttttggtctagttctcntcatgctgaggtcccacatgcaccagttctacccg

SEQ ID NO: 39552 - DNA, 71 bp, chicken (Gallus Gallus)
  misc_feature (36): n=a or g
cagaaaaatagcactgaataggaatagatcacaccnaacctgcgctgtgataggaaagctcttggtgctcc

SEQ ID NO: 39553 - DNA, 71 bp, chicken (Gallus Gallus)
  misc_feature (36): n=c or t
tgtgctcatgtacaaatacaaacacgtccagagaanggagtaggggtttctatgcagtgaaaggaaagcgg

SEQ ID NO: 39554 - DNA, 71 bp, chicken (Gallus Gallus)
  misc_feature (36): n=a or g
caagcttcatcagagaaatccttgaaaaaaatctgnatacctgaattgggccttgctcaactcagagactg

SEQ ID NO: 39555 - DNA, 71 bp, chicken (Gallus Gallus)
  misc_feature (36): n=a or g
gaatttgccaaaaatgcttcaagaagctgcaaaacntggcaatagcagttaatgctcaaattatatcccaa

SEQ ID NO: 39556 - DNA, 71 bp, chicken (Gallus Gallus)
  misc_feature (36): n=a or g
tgatgtgcacgcactgcccaggctcctgtcaggctncaggaccattttctgaggattacagtgtcctccca

SEQ ID NO: 39557 - DNA, 71 bp, chicken (Gallus Gallus)
  misc_feature (36): n=c or t
ggaaagatttccatttaattgtacagtaaacttacnatgatctgggggattgctgagagatttcatttaca

SEQ ID NO: 39558 - DNA, 71 bp, chicken (Gallus Gallus)
  misc_feature (36): n=a or g
tccgccggcgccagaggtgaggtagtgccggcccancacacggccctcaagctcggcccgccccaccgcgc

SEQ ID NO: 39559 - DNA, 71 bp, chicken (Gallus Gallus)
  misc_feature (36): n=c or t
cacccagtgagcaatacaactcttaatgcttttttncttctgtcaaaggtattgactttgcaacacgcaag

SEQ ID NO: 39560 - DNA, 71 bp, chicken (Gallus Gallus)
  misc_feature (36): n=c or t
gactgcagcgacgtcgcgtagacatgggcttgacanggatttttcttcactctttaacttcctcagcagtt

SEQ ID NO: 39561 - DNA, 71 bp, chicken (Gallus Gallus)
  misc_feature (36): n=a or g
cccgacagatgagacaagagtgaaagcaacaatggnggatgttacagcctggattgctgagctttgtgagt

SEQ ID NO: 39562 - DNA, 71 bp, chicken (Gallus Gallus)
  misc_feature (36): n=a or g
ttctggaaacaatactatgttagctgtgcttgtacngtgttttgcgtcccagaagatgcatgtggtgttcc

SEQ ID NO: 39563 - DNA, 71 bp, chicken (Gallus Gallus)
  misc_feature (36): n=c or t
tgcaaccagaactacatccgaaatccttatttagtngctaagctggtggaggtgatgttcatgaccaatcc

SEQ ID NO: 39564 - DNA, 71 bp, chicken (Gallus Gallus)
  misc_feature (36): n=c or t
agagttcagtgtcttggcagagcagcccagcccttnttacagcctactcagtgcaccttctgtaagtgaac

SEQ ID NO: 39565 - DNA, 71 bp, chicken (Gallus Gallus)
  misc_feature (36): n=a or g
ttgagctttgtttatgtaacctgtagcctgagctcnagtaacctttcagctgtcagctttattaacttgtt

SEQ ID NO: 39566 - DNA, 71 bp, chicken (Gallus Gallus)
  misc_feature (36): n=c or t
gtgggaattctgagtatagagataccacggtaagcntgtttcttacccaaaatggatggataaaatacact

SEQ ID NO: 39567 - DNA, 71 bp, chicken (Gallus Gallus)
  misc_feature (36): n=c or t
tatctgcagggctgagaaaagagctgatttattgtngcctcagagtgaaaatccagctccccttcatagca

SEQ ID NO: 39568 - DNA, 71 bp, chicken (Gallus Gallus)
  misc_feature (36): n=a or g
tctctgcacaacctggagatctgccaaactttgtcnttttctgagttatctcacggtagaaagaaattccc

SEQ ID NO: 39569 - DNA, 71 bp, chicken (Gallus Gallus)
  misc_feature (36): n=c or t
taatcactgaaaaccaaccgaacacccatgccacangagcttgggttacttggcaccagttggaaacagat

SEQ ID NO: 39570 - DNA, 71 bp, chicken (Gallus Gallus)
  misc_feature (36): n=a or g
acctcacagcacagggaaacgcaaccgggcaatttnttaaagcagaacaactcttctattattattataac

SEQ ID NO: 39571 - DNA, 71 bp, chicken (Gallus Gallus)
  misc_feature (36): n=a or g
gcacgcaccgacttctcacttacagctgccatttcntttcacttgaaaatctaagtgtggaaaccgtgcaa

SEQ ID NO: 39572 - DNA, 71 bp, chicken (Gallus Gallus)
  misc_feature (36): n=c or t
ctactagatgagatgtaaaccagccactgccttctngccttattctctctatatcattccatcagcatcag

SEQ ID NO: 39573 - DNA, 71 bp, chicken (Gallus Gallus)
  misc_feature (36): n=a or g
tcagtctggtagaaaagggtgccccagctccgttcntaaatgtagtgccagcaaagcgaatggaaacaagc

SEQ ID NO: 39574 - DNA, 71 bp, chicken (Gallus Gallus)
  misc_feature (36): n=a or g
tgagaggcagagctgggaaacagcccctgggggacnaggcgaaaaacagttcctgaaaagcctgcatacca

SEQ ID NO: 39575 - DNA, 71 bp, chicken (Gallus Gallus)
  misc_feature (36): n=a or g
ttcattgttcaactcagtacagcacaccactagacngagtcactggccttgcccattggctagaccataag

SEQ ID NO: 39576 - DNA, 71 bp, chicken (Gallus Gallus)
  misc_feature (36): n=a or g
gtcaaaacgtctcagcagcagggagctcctattagnagagagcaagctaactttgtgcacaaagctctcgc

SEQ ID NO: 39577 - DNA, 71 bp, chicken (Gallus Gallus)
  misc_feature (36): n=a or g
tacaggaaacaaaactataatattttttctaaagcnactgcttatgttactgaccaactgtgcactttgtt

SEQ ID NO: 39578 - DNA, 71 bp, chicken (Gallus Gallus)
  misc_feature (36): n=a or g
tgaatttctttacaataactgccagtggagccccantaattaatgactgattgtggtgccctttgttttgt

SEQ ID NO: 39579 - DNA, 71 bp, chicken (Gallus Gallus)
  misc_feature (36): n=a or g
tgaaacattactgaagtttatgttcaaatacaaacnacttacctcaaaacagtccccaaagtcgatatgca

SEQ ID NO: 39580 - DNA, 71 bp, chicken (Gallus Gallus)
  misc_feature (36): n=a or g
taatagaaagaaattaaatcaaccatgcattataangtttctcttctttatgcccttgacctgttgagttt

SEQ ID NO: 39581 - DNA, 71 bp, chicken (Gallus Gallus)
  misc_feature (36): n=a or g
ggtgctaccattacacaccatgcgtggaacagcacngagcactcggatttgaattcagaggagtactgagg

SEQ ID NO: 39582 - DNA, 71 bp, chicken (Gallus Gallus)
  misc_feature (36): n=c or t
accaaaaatttcctagtagaatttaatgatgcagtnccttggattctacaaacaacacttagccatggaaa

SEQ ID NO: 39583 - DNA, 71 bp, chicken (Gallus Gallus)
  misc_feature (36): n=c or t
tccacggtgcagggaactcctaaaacttggagaccnccacccccaaaacttggaacctacaaatctcggag

SEQ ID NO: 39584 - DNA, 71 bp, chicken (Gallus Gallus)
  misc_feature (36): n=c or t
cctttctgctggcagcaccgtgttccttggcaaatnggtgagcagggaattccagcaggaatttcagcaca

SEQ ID NO: 39585 - DNA, 71 bp, chicken (Gallus Gallus)
  misc_feature (36): n=a or g
gttatttggcaaggcagcaggttgtgttcagaagcntcctcagcagattcatcaaagagcatggttaatgt

SEQ ID NO: 39586 - DNA, 71 bp, chicken (Gallus Gallus)
  misc_feature (36): n=a or g
cacgctgctgttttggaagctcttttatacagtctntaatcatggggctctaaaggtaatggtgaggtgca

SEQ ID NO: 39587 - DNA, 71 bp, chicken (Gallus Gallus)
  misc_feature (36): n=a or g
taatatgctccaaataagcccccagtcttatcacanataaaaagacaaatggtaaagtagattttcagaga

SEQ ID NO: 39588 - DNA, 71 bp, chicken (Gallus Gallus)
  misc_feature (36): n=c or t
aagaaccaaaacaagatgcaaaactttatttaaganggacaaaagagctgtttttctaccagttatctgtc

SEQ ID NO: 39589 - DNA, 71 bp, chicken (Gallus Gallus)
  misc_feature (36): n=c or t
gaaacagagtaccactctggcttcctcacctttccngaagcagtgaccatcaccatcattttctggaggtt

SEQ ID NO: 39590 - DNA, 71 bp, chicken (Gallus Gallus)
  misc_feature (36): n=c or t
ttctctgtgtcaatcatctacagacaaatgtttagntaagtacctttcctgcaactctaagtgatcaaaac

SEQ ID NO: 39591 - DNA, 71 bp, chicken (Gallus Gallus)
  misc_feature (36): n=c or t
gatagaactgtgctacaggaagcctaagaggaaccngttagtgtcagccctttaatgggataatgacatca

SEQ ID NO: 39592 - DNA, 71 bp, chicken (Gallus Gallus)
  misc_feature (36): n=a or g
tcagtcagctggaaggagccatcacttcagaaagcnatggaaagatttccaatttaacatcaagagtttcc

SEQ ID NO: 39593 - DNA, 71 bp, chicken (Gallus Gallus)
  misc_feature (36): n=a or c
gtcttcatcacaccagattaaatagcaagtggaganacccagctgcgctagaggaccatgttgcacaaaag

SEQ ID NO: 39594 - DNA, 71 bp, chicken (Gallus Gallus)
  misc_feature (36): n=c or t
tgctgcttttgctagaaaggaaactaggataaaatngataggcaccctgagctttttgagcattttaaagt

SEQ ID NO: 39595 - DNA, 71 bp, chicken (Gallus Gallus)
  misc_feature (36): n=c or t
atatgacggccagaattgcagagtaaattcctagtnttcaatttacaatgtgtacatctgtttggaagtga

SEQ ID NO: 39596 - DNA, 71 bp, chicken (Gallus Gallus)
  misc_feature (36): n=c or t
tttccccccccagattagttttcagtaattacatantgcccactcgcggcaagtttacttcttagcattca

SEQ ID NO: 39597 - DNA, 71 bp, chicken (Gallus Gallus)
  misc_feature (36): n=a or g
tctggcactcccaaccatgtattcttgctgctaacntgggttgagtttcaggagcatcttgcaggagggca

SEQ ID NO: 39598 - DNA, 71 bp, chicken (Gallus Gallus)
  misc_feature (36): n=c or t
ggggagcctgatggctctgactctagcagcactgtnagagagcagaaaagcgtggttttgttggaggattt

SEQ ID NO: 39599 - DNA, 71 bp, chicken (Gallus Gallus)
  misc_feature (36): n=a or g
ccttatttttgtagtgttaaagcaatggaggcaatnatcagagctgccatctgtcagggtaggcaggcagt

SEQ ID NO: 39600 - DNA, 71 bp, chicken (Gallus Gallus)
  misc_feature (36): n=c or t
ttccctcgccccatccctcacacctgcctaacaaancccagtggctcctatagctgaccaagaaaagccca

SEQ ID NO: 39601 - DNA, 71 bp, chicken (Gallus Gallus)
  misc_feature (36): n=c or t
tatctcggcagcaaagcagaaacctttcctccctgnagactgccctgcaatagaccaaacggtggcactga

SEQ ID NO: 39602 - DNA, 71 bp, chicken (Gallus Gallus)
  misc_feature (36): n=a or g
tgatcaactatgtctgcatgcttcaagctcagctcnggtggatttccatatagttaaagcaagtaactcaa

SEQ ID NO: 39603 - DNA, 71 bp, chicken (Gallus Gallus)
  misc_feature (36): n=a or g
acaagagctcctacagcttacagtaagagcaacacntttctgtctgtgaactgggatctctgaccattgtt

SEQ ID NO: 39604 - DNA, 71 bp, chicken (Gallus Gallus)
  misc_feature (36): n=a or g
acagatactgctttgtagcaagacaaagacaccacngaaatttataaaggttttggttcactttcctgtat

SEQ ID NO: 39605 - DNA, 71 bp, chicken (Gallus Gallus)
  misc_feature (36): n=c or t
ccctgtactgattcatttaggaaggaaggttttaanagagttactaaatgacaaaaagagtgcagcagtaa

SEQ ID NO: 39606 - DNA, 71 bp, chicken (Gallus Gallus)
  misc_feature (36): n=c or t
acataagaggtcttccctgcaagacatacaagctgnataaagttggcttttgacacttcctgacaattttg

SEQ ID NO: 39607 - DNA, 71 bp, chicken (Gallus Gallus)
  misc_feature (36): n=c or t
ggtgacagctatctttatgtcctctggcactgcagngagagatgcaagtgtttaagttacatcgtaactta

SEQ ID NO: 39608 - DNA, 71 bp, chicken (Gallus Gallus)
  misc_feature (36): n=c or t
ctggggaaaaacatatgcaaaacaacctacaaatancctcagtccttcagtaaagaggaacagaagataga

SEQ ID NO: 39609 - DNA, 71 bp, chicken (Gallus Gallus)
  misc_feature (36): n=c or t
tatcttggatgccggcacctatctaaataatgcagngagtttaccttaaatgattatttaatggttttatt

SEQ ID NO: 39610 - DNA, 71 bp, chicken (Gallus Gallus)
  misc_feature (36): n=a or g
tttgagctcgctgtgttaatgctgcaccaagaggcnagatggttttagttctgtattattgcttttagaag

SEQ ID NO: 39611 - DNA, 71 bp, chicken (Gallus Gallus)
  misc_feature (36): n=a or c
gaagtatggttgcaaagctgagacttcattctctcntgtctatgcccacaccttttctgctttattcagtt

SEQ ID NO: 39612 - DNA, 71 bp, chicken (Gallus Gallus)
  misc_feature (36): n=a or g
gcagcagctgcctttcagatggctcagcagtagtcntgcatttgtaggagagagctgagctcagtgcatcg

SEQ ID NO: 39613 - DNA, 71 bp, chicken (Gallus Gallus)
  misc_feature (36): n=c or t
ccctattgctgatctttcaacttagaatggagtctntttaaagcaagaatagtatttactgttggttttta

SEQ ID NO: 39614 - DNA, 71 bp, chicken (Gallus Gallus)
  misc_feature (36): n=a or g
cttccatcactgtgaggtgcagtacgcttaacttancccctccacccacttagcaaatccagacctgtgga

SEQ ID NO: 39615 - DNA, 71 bp, chicken (Gallus Gallus)
  misc_feature (36): n=a or g
actgtgggccaatcatcagtgtttcactttgacacntttcctattatgagcaacaacactgcgtaacggtt

SEQ ID NO: 39616 - DNA, 71 bp, chicken (Gallus Gallus)
  misc_feature (36): n=c or t
tggctctggaacaagtctgcttcataaatacagtgngtgctttgtctatgggggttttagtgcatttcaga

SEQ ID NO: 39617 - DNA, 71 bp, chicken (Gallus Gallus)
  misc_feature (36): n=c or t
cctttaaaatgagacaaaattgctacatacacattntctgtaccctttcaacattatttgggggatgttcc

SEQ ID NO: 39618 - DNA, 71 bp, chicken (Gallus Gallus)
  misc_feature (36): n=c or t
tggcagcaaagagtatattagatactgctgtaaaangagcaactaccagcaccaaaacagaaaaggtaaag

SEQ ID NO: 39619 - DNA, 71 bp, chicken (Gallus Gallus)
  misc_feature (36): n=c or t
gaagtgaggctgtgtgggtatcagcgctgaacaccntgactcgtccacccacactacaggccaggggtgta

SEQ ID NO: 39620 - DNA, 71 bp, chicken (Gallus Gallus)
  misc_feature (36): n=c or t
aacctgatccaagtgtctttcaatgtgcctttttcngaaagcaccaagcactgaccttgccagctacctgc

SEQ ID NO: 39621 - DNA, 71 bp, chicken (Gallus Gallus)
  misc_feature (36): n=g or t
aaaggctgtttcccaatatctaaccaaggggtgttnctcttttggcagcttggaatgagagctaccaagaa

SEQ ID NO: 39622 - DNA, 71 bp, chicken (Gallus Gallus)
  misc_feature (36): n=g or t
cattggaatggaaagtggcctgttttggaatgtggntgacacttactgcatatttgtccactagatcagaa

SEQ ID NO: 39623 - DNA, 71 bp, chicken (Gallus Gallus)
  misc_feature (36): n=g or t
cgagctcgtgaaagtgctgcacttagaacacttcgngaaagggagaacgaagcaaccacatctccgcaaga

SEQ ID NO: 39624 - DNA, 71 bp, chicken (Gallus Gallus)
  misc_feature (36): n=a or g
agaagaacagctgtgtttgaagaggaatccagctcntaggtctttctgttaaaagtctgattcgtgttcac

SEQ ID NO: 39625 - DNA, 71 bp, chicken (Gallus Gallus)
  misc_feature (36): n=a or g
taaagtataattagtggaccttcattaactaacacnaagcacctatattgccattgctgctgctttgaact

SEQ ID NO: 39626 - DNA, 71 bp, chicken (Gallus Gallus)
  misc_feature (36): n=c or t
aggaatttgtataggttctggcaacagtgtttaaanatgaaccctgaccatctgattttaacatcagagaa

SEQ ID NO: 39627 - DNA, 71 bp, chicken (Gallus Gallus)
  misc_feature (36): n=g or t
taaccttctcttgctgtcttggtatactgcaaagcntacacctccatcctctgaaatgagaagtgcttttt

SEQ ID NO: 39628 - DNA, 71 bp, chicken (Gallus Gallus)
  misc_feature (36): n=c or t
tctcctctgtgtggtgcagtaatacagtccctgctnctgaggtccagtggcagaaccagtaaatgaaccta

SEQ ID NO: 39629 - DNA, 71 bp, chicken (Gallus Gallus)
  misc_feature (36): n=g or t
aaaacagcttgccaactgctggatgcagagagtgtngtcctacgccatctgatattgctagtttgattcca

SEQ ID NO: 39630 - DNA, 71 bp, chicken (Gallus Gallus)
  misc_feature (36): n=c or t
catttctttggactggcccagaagccagcttattgnagcatcatatcctgagaactaactccctaaagcga

SEQ ID NO: 39631 - DNA, 71 bp, chicken (Gallus Gallus)
  misc_feature (36): n=a or g
gtgacaaagttgagtgccacaacgtacctcaggagnatctcttgcagggagataatggtagcaacagctaa

SEQ ID NO: 39632 - DNA, 71 bp, chicken (Gallus Gallus)
  misc_feature (36): n=a or g
tcacagcactgtggttctttggcattcctctctacngaaggttcttcagagtggtcaggagcttcccaatt

SEQ ID NO: 39633 - DNA, 71 bp, chicken (Gallus Gallus)
  misc_feature (36): n=a or g
agcttttattcttggaatgacatctttccccttccntctctgattaagcagtacaacctgtgccctagcat

SEQ ID NO: 39634 - DNA, 71 bp, chicken (Gallus Gallus)
  misc_feature (36): n=c or t
tcgcaaccctggcctccccttcaagagatgggagtnactgcaagacctgatcaagcatatttagtctcttt

SEQ ID NO: 39635 - DNA, 71 bp, chicken (Gallus Gallus)
  misc_feature (36): n=a or g
tgcataggaggggctcaccaaggtgcttgtaggggnctctcagcagcccagaaggttggatctcagcaggc

SEQ ID NO: 39636 - DNA, 71 bp, chicken (Gallus Gallus)
  misc_feature (36): n=c or t
gccacaaacatctcagctacactgcaatttcactgntataattgtcaagaagaagtaaaaggaagcaagaa

SEQ ID NO: 39637 - DNA, 71 bp, chicken (Gallus Gallus)
  misc_feature (36): n=c or t
atgtaagccatcagtttatgggggtaagcacacagngattcaggccctcggtgtcagcttccatggggact

SEQ ID NO: 39638 - DNA, 71 bp, chicken (Gallus Gallus)
  misc_feature (36): n=a or g
ccaggggcgtatttctgaactgggcatgccctcacnttgcccctgccctacatctccatctggctgctttt

SEQ ID NO: 39639 - DNA, 71 bp, chicken (Gallus Gallus)
  misc_feature (36): n=c or t
tatataaagaatcagggaaaatagcaaccatttccntcaccaacaaagacactgaaaggcccagagataca

SEQ ID NO: 39640 - DNA, 71 bp, chicken (Gallus Gallus)
  misc_feature (36): n=c or t
ccctatcatactgctccttgggattacatactgtgnaagcttactcattcatctgtagctccaagaaacag

SEQ ID NO: 39641 - DNA, 71 bp, chicken (Gallus Gallus)
  misc_feature (36): n=c or t
tcacagcttgcaaccaggatcttccaaagcctttcngtttgcagagtgaaatggcagcattagagaacttt

SEQ ID NO: 39642 - DNA, 71 bp, chicken (Gallus Gallus)
  misc_feature (36): n=g or t
agcccaccaagcacaggatcaccaatcaggagaggnacctcacttctcatgagattttagacagggactgg

SEQ ID NO: 39643 - DNA, 71 bp, chicken (Gallus Gallus)
  misc_feature (36): n=a or g
tctgcataaccccaccaggtgggacctgtggttganggacttttcagttgtgaaactccattgggtggcag

SEQ ID NO: 39644 - DNA, 71 bp, chicken (Gallus Gallus)
  misc_feature (36): n=a or c
tgctggacctgagatacccatcccttcttacaacantgaacctcagatatccatcccttcttccaacactg

SEQ ID NO: 39645 - DNA, 71 bp, chicken (Gallus Gallus)
  misc_feature (36): n=c or t
tgtcacagcacgccagcacactaacctggtgagccncattcaggaccaagccttgcaaagcaatgctggca

SEQ ID NO: 39646 - DNA, 71 bp, chicken (Gallus Gallus)
  misc_feature (36): n=c or t
tcttaggggtaacgggcatgggtcaatggctggacnagatgatctcagtgatcctaggattttatgatctg

SEQ ID NO: 39647 - DNA, 71 bp, chicken (Gallus Gallus)
  misc_feature (36): n=a or g
ataatcctccaaactccatttggctgaatgaaagtnaaggaataagaacagctcaaccacaccatcttccc

SEQ ID NO: 39648 - DNA, 71 bp, chicken (Gallus Gallus)
  misc_feature (36): n=a or g
acttaaatgattcagaaatttgttttcagggagtanttcaagttacgatgtgggttttctgagggtttgcc

SEQ ID NO: 39649 - DNA, 71 bp, chicken (Gallus Gallus)
  misc_feature (36): n=c or t
aaggtccctgtccaaaaaagaggaacaaaagccccncaccaaagctgttgctgtcctctgcctttggcatt

SEQ ID NO: 39650 - DNA, 71 bp, chicken (Gallus Gallus)
  misc_feature (36): n=a or g
gtgaagatgactcaagtcaaagaccaagcccacatnatttccaccagacccaaaacggcagggagacttcg

SEQ ID NO: 39651 - DNA, 71 bp, chicken (Gallus Gallus)
  misc_feature (36): n=a or g
ctgctcagctccaaacacgagcaatggcaagaagcngatttcttctttttgcagtggttggtggtgactcc

SEQ ID NO: 39652 - DNA, 71 bp, chicken (Gallus Gallus)
  misc_feature (36): n=g or t
ggggttggatcaggatgcaacttcagttcctgaaanaacatgccttgggagaagagaatatccatcagggc

SEQ ID NO: 39653 - DNA, 71 bp, chicken (Gallus Gallus)
  misc_feature (36): n=a or g
gtactgttttccctaaaagcgaagatgcagctacancagagctcagcaagctggaggtaaggtggtcctgc

SEQ ID NO: 39654 - DNA, 71 bp, chicken (Gallus Gallus)
  misc_feature (36): n=c or t
gcacccagccttacatgcactgaaaaatggaagtgngaacttgggtcttcatagctgctaagtaacatatc

SEQ ID NO: 39655 - DNA, 71 bp, chicken (Gallus Gallus)
  misc_feature (36): n=a or g
gctgcactgccattatatataccagtggtgaacacnttcagatgtttcattcctttctgccaaatcaacac

SEQ ID NO: 39656 - DNA, 71 bp, chicken (Gallus Gallus)
  misc_feature (36): n=a or g
agcagtatggggagggtgagattattcaatgccccntctttgttttcctattcagagggcaaacaacaatg

SEQ ID NO: 39657 - DNA, 71 bp, chicken (Gallus Gallus)
  misc_feature (36): n=a or g
actgaggggggaaaccgggttgtgggaagatagagnacaggggaagcatgggatacccaaatccagcccca

SEQ ID NO: 39658 - DNA, 71 bp, chicken (Gallus Gallus)
  misc_feature (36): n=a or g
acatgggccagttattacatcagttggtgcagtccngaaagctgagcaagcaggatttcttcaaggggttt

SEQ ID NO: 39659 - DNA, 71 bp, chicken (Gallus Gallus)
  misc_feature (36): n=a or c
tccaaaacgcttcctattgtttcttatctttttgtntctccgtgctaaccagtgtcagtgatttctgtttg

SEQ ID NO: 39660 - DNA, 71 bp, chicken (Gallus Gallus)
  misc_feature (36): n=g or t
acgaagaggtaatatcagaggatgccttctacaagngggaaagcagcaaggacccagcagagcagaacggg

SEQ ID NO: 39661 - DNA, 71 bp, chicken (Gallus Gallus)
  misc_feature (36): n=a or g
acttcacattggaggcagggtctggatctagggacncttgcacaacactggggccatggggacttggtgtc

SEQ ID NO: 39662 - DNA, 71 bp, chicken (Gallus Gallus)
  misc_feature (36): n=g or t
gagcacttttttcatggtgcattttttttcacagtncacctttcgatggtggatcttttgcacaatgcatt

SEQ ID NO: 39663 - DNA, 71 bp, chicken (Gallus Gallus)
  misc_feature (36): n=c or t
cagaacgacttttattgctgtaagtttacattactngcagatgctgaagagggctttacccaaaccgggct

SEQ ID NO: 39664 - DNA, 71 bp, chicken (Gallus Gallus)
  misc_feature (36): n=c or t
tctttttagaaacatgtttcagtcactcctgtgggnccatctcaagcctcagaacaggcgtgcagtcctca

SEQ ID NO: 39665 - DNA, 71 bp, chicken (Gallus Gallus)
  misc_feature (36): n=a or g
aaggtcagagtgagttaatgaacttggtactctacnatgtactctgcaggaacttcagtgatagcctatga

SEQ ID NO: 39666 - DNA, 71 bp, chicken (Gallus Gallus)
  misc_feature (36): n=c or t
aaagttgctctctgtgacccaaacccagtgggagangtgtgagccgtgtcctcacttcccacctctgctca

SEQ ID NO: 39667 - DNA, 71 bp, chicken (Gallus Gallus)
  misc_feature (36): n=c or t
gagtaaatagttcaagattggttccagccctgtttncctcctgacctggtgcaaatcaataccggggtcgt

SEQ ID NO: 39668 - DNA, 71 bp, chicken (Gallus Gallus)
  misc_feature (36): n=a or g
tattgatgctgctctttgtagttgttaaaacgcacnctcacaaatggcttcatggacactccgttcttatc

SEQ ID NO: 39669 - DNA, 71 bp, chicken (Gallus Gallus)
  misc_feature (36): n=a or g
cctctgcaggatgtgatcctcctagttttcctgtgntctcatatctcattggagatttccagctcagattt

SEQ ID NO: 39670 - DNA, 71 bp, chicken (Gallus Gallus)
  misc_feature (36): n=a or g
gtgaagcattaaacagagtttgatggatggttttgngcatgagcagccaggagtgagctgggcaggttgct

SEQ ID NO: 39671 - DNA, 71 bp, chicken (Gallus Gallus)
  misc_feature (36): n=c or t
ggcttgcaggggattttcctgccccacaagcgttgngttgctccgtaccccatttcttccccatctccttc

SEQ ID NO: 39672 - DNA, 71 bp, chicken (Gallus Gallus)
  misc_feature (36): n=c or t
ttcaggagattttctatttggtttcccagtctgctngcttccttaacgcataacatgactgattatgtaca

SEQ ID NO: 39673 - DNA, 71 bp, chicken (Gallus Gallus)
  misc_feature (36): n=c or t
gagctctctgctgatccacgcagcaccggggccatncgcatcccgttagcttgtacacattgccacggtga

SEQ ID NO: 39674 - DNA, 71 bp, chicken (Gallus Gallus)
  misc_feature (36): n=c or t
agccctcctcgtgcacaataagggctggacttctgnggcctcagacctcattccactcgaggtgttattca

SEQ ID NO: 39675 - DNA, 71 bp, chicken (Gallus Gallus)
  misc_feature (36): n=a or g
ggacagtggggttctgctggtgccccaaaatgggcngtccccaacaacctgagaagatcttatttcgttcc

SEQ ID NO: 39676 - DNA, 71 bp, chicken (Gallus Gallus)
  misc_feature (36): n=a or c
atttattgacaagcaaagctcccattggattcttgnattgcaagacggcctctgcagggctctgcttactc

SEQ ID NO: 39677 - DNA, 71 bp, chicken (Gallus Gallus)
  misc_feature (36): n=a or g
ataaaaagttatggtttagaagaagaacttccagtngtagcacaggatggctggggctgtgcaaggtctgc

SEQ ID NO: 39678 - DNA, 71 bp, chicken (Gallus Gallus)
  misc_feature (36): n=a or g
ggaactgctggagatgtgggaggtctgccatttgcntcaacttcatgattttatctttttcttaaaggatc

SEQ ID NO: 39679 - DNA, 71 bp, chicken (Gallus Gallus)
  misc_feature (36): n=c or t
atcccctttcaaacacctggggtgggatgtcacgtngctcagaaggtcctacatctggacaggcggaacaa

SEQ ID NO: 39680 - DNA, 71 bp, chicken (Gallus Gallus)
  misc_feature (36): n=c or t
gagaagaagcatgaagctgtccatcaggagcgctangattacgccaagaaactcaaacaagctattgcaga

SEQ ID NO: 39681 - DNA, 71 bp, chicken (Gallus Gallus)
  misc_feature (36): n=a or g
ccttctgcctcctgaatgctcccagtgagatgccancatggcagcaaagcagcgtattaaaataatgactc

SEQ ID NO: 39682 - DNA, 71 bp, chicken (Gallus Gallus)
  misc_feature (36): n=a or g
gctgcttacagctcttgcatgtatgggcagctccanggaactgtgagtcctgatagcttccaacaaacagg

SEQ ID NO: 39683 - DNA, 71 bp, chicken (Gallus Gallus)
  misc_feature (36): n=g or t
agcaggacaggtcatccccaccaaggacagctgcanctcacaagagataccagcatgccgtgctcactgtg

SEQ ID NO: 39684 - DNA, 71 bp, chicken (Gallus Gallus)
  misc_feature (36): n=a or g
tgtcgtagagggagaactgcctcaaaacccactcancttaaacgttttctgatgctgagactttttgttct

SEQ ID NO: 39685 - DNA, 71 bp, chicken (Gallus Gallus)
  misc_feature (36): n=c or t
aaatcagcctgatagagaaaccctctgctattcaangttgggttttcaacaacacttcctagcatccacgt

SEQ ID NO: 39686 - DNA, 71 bp, chicken (Gallus Gallus)
  misc_feature (36): n=a or g
aagggagcagctcattctgggaggggtttctggggnggacgtgttagcactctgccttttgagttaataga

SEQ ID NO: 39687 - DNA, 71 bp, chicken (Gallus Gallus)
  misc_feature (36): n=c or t
ctttcattgatgtagtctctcaaacttcctaaaatncttaaaatattcagcataatcaagcatttctggat

SEQ ID NO: 39688 - DNA, 71 bp, chicken (Gallus Gallus)
  misc_feature (36): n=c or t
ggactgtctgcaggggatcctgagtgttatcccccnccagcttctggcttttcaccttgcagttctcagag

SEQ ID NO: 39689 - DNA, 71 bp, chicken (Gallus Gallus)
  misc_feature (36): n=c or t
ctatgttattagagaaggggcgtaacacagctgtanctctgtctcaaaaaaggctttgctttatctatggc

SEQ ID NO: 39690 - DNA, 71 bp, chicken (Gallus Gallus)
  misc_feature (36): n=a or g
tgctgggaagagctttaaaatgaggttaagtccgcncaccagcatcagagctaactgagttagagcccatc

SEQ ID NO: 39691 - DNA, 71 bp, chicken (Gallus Gallus)
  misc_feature (36): n=a or c
gctcagttcatccctacgtgatgacatccatgttancccagcgaggcaaagcagcctcgtgccaccacctc

SEQ ID NO: 39692 - DNA, 71 bp, chicken (Gallus Gallus)
  misc_feature (36): n=c or t
tggaggagctctcccagaactgctctatatgtcgtnggatcaacacgttgtgcgcctttgtctgctttctg

SEQ ID NO: 39693 - DNA, 71 bp, chicken (Gallus Gallus)
  misc_feature (36): n=c or t
agacagaaattacagcaagattgaaagctgagatcntaatacgttttccctcaggtgttcttaagctctga

SEQ ID NO: 39694 - DNA, 71 bp, chicken (Gallus Gallus)
  misc_feature (36): n=c or t
tcctcctttagtgtttgcattgactatttcattatnccattaatgcaatattgtgttgaaaaagcagagct

SEQ ID NO: 39695 - DNA, 71 bp, chicken (Gallus Gallus)
  misc_feature (36): n=a or g
ggaaaaaaaagcacagcagaaacaacaggcatccanatccatcctaagatataagatcagtgcagccataa

SEQ ID NO: 39696 - DNA, 71 bp, chicken (Gallus Gallus)
  misc_feature (36): n=c or t
agctgtgctgcaggcgctgagcttccagtggctctnagcctcgtgcaggggatgcaaaggagatttgggca

SEQ ID NO: 39697 - DNA, 71 bp, chicken (Gallus Gallus)
  misc_feature (36): n=a or c
ccctgtgtgctctgggcagtaccagccgagcatcanacagtccatctatcttcatgttcctttcttgcagt

SEQ ID NO: 39698 - DNA, 71 bp, chicken (Gallus Gallus)
  misc_feature (36): n=c or t
ctgacaatcctggacgatcccacccatggcgaaggngcaatgacagtcaattctgtggttctttctatgca

SEQ ID NO: 39699 - DNA, 71 bp, chicken (Gallus Gallus)
  misc_feature (36): n=a or g
gtatatcttagggaactaagagaaatcaaaccagcntgaatacttgccagcttgtacattatgcagtactt

SEQ ID NO: 39700 - DNA, 71 bp, chicken (Gallus Gallus)
  misc_feature (36): n=a or g
cagtgctgcaaggggggctggcagaaatatacatcncagcaatgggaaatgcacctctttctgtcctcctt

SEQ ID NO: 39701 - DNA, 71 bp, chicken (Gallus Gallus)
  misc_feature (36): n=c or t
ctgagtgtaaggggatcaattcataaagctggatgngaacatgaaatgcaaagaggtgttttgcaggttgc

SEQ ID NO: 39702 - DNA, 71 bp, chicken (Gallus Gallus)
  misc_feature (36): n=c or t
tccttgtttcttgtcatcctcaaatacctggcaacntggtaaagaaacagaggagtcagatactgtgtgta

SEQ ID NO: 39703 - DNA, 71 bp, chicken (Gallus Gallus)
  misc_feature (36): n=a or g
aaggaatgtcttgtgttagctgttggcacagaacanaggatctaattctgactcttacagtgctgaaattg

SEQ ID NO: 39704 - DNA, 71 bp, chicken (Gallus Gallus)
  misc_feature (36): n=c or t
caagctggggctgccacatgagggataattcctacnctcttaaagtactgtgagaaagatgctgccttcca

SEQ ID NO: 39705 - DNA, 71 bp, chicken (Gallus Gallus)
  misc_feature (36): n=c or t
cccccggaatgctgtgtgtagagacaaatgcttttnaggaaagcacatcagttttgtcagactggatccca

SEQ ID NO: 39706 - DNA, 71 bp, chicken (Gallus Gallus)
  misc_feature (36): n=c or t
taatgcaatttgttccatgactgatcttcagatccntgcttcattaccttgcacaaacttaaacctgtttc

SEQ ID NO: 39707 - DNA, 71 bp, chicken (Gallus Gallus)
  misc_feature (36): n=c or t
ctaatggaaaaggcctctggcagtattggttcaaantgagctttaattatcaattatcagtatgttatcag

SEQ ID NO: 39708 - DNA, 71 bp, chicken (Gallus Gallus)
  misc_feature (36): n=c or t
aatcctttgtttctgtgatagtttgttatgaacatngcatctgctcttctggatggtggagagtttcacct

SEQ ID NO: 39709 - DNA, 71 bp, chicken (Gallus Gallus)
  misc_feature (36): n=c or t
aatgcagttgtatggtggatatgcagtcactgaaancatcttgatgcagcacagaactttgggagcttgac

SEQ ID NO: 39710 - DNA, 71 bp, chicken (Gallus Gallus)
  misc_feature (36): n=c or t
gagccccagactgtgagcttcagttaaaggagcaancacgtcactactttaacaagtgtgaatggcttact

SEQ ID NO: 39711 - DNA, 71 bp, chicken (Gallus Gallus)
  misc_feature (36): n=a or c
ccatcctgcctgcaaggtgtagcaaatacatgaaancactgtttactgaggtctgagtcaatgtgttttac

SEQ ID NO: 39712 - DNA, 71 bp, chicken (Gallus Gallus)
  misc_feature (36): n=a or g
cccctgacctgagatcccataggataccaggcgccngggaacaatgcccagacagcacagggatcgtggcc

SEQ ID NO: 39713 - DNA, 71 bp, chicken (Gallus Gallus)
  misc_feature (36): n=c or t
gaaggagggctcagtaccagcactccagtgatcttnggggtcagcaaagggatggtggggtgaggagagtc

SEQ ID NO: 39714 - DNA, 71 bp, chicken (Gallus Gallus)
  misc_feature (36): n=a or c
cagtgcttccctccacaggttcccattacagggganaccactaccagacagagctctaaaatcagatggta

SEQ ID NO: 39715 - DNA, 71 bp, chicken (Gallus Gallus)
  misc_feature (36): n=g or t
acatcagttgaggctcgactcctcttctttaaaggnttacaagaatctgaaatctcgctggcaccttaaca

SEQ ID NO: 39716 - DNA, 71 bp, chicken (Gallus Gallus)
  misc_feature (36): n=c or t
tggagatggggacattcagctcagagagattctgtntccttttgctgtgagctttaaggcaaactccgcag

SEQ ID NO: 39717 - DNA, 71 bp, chicken (Gallus Gallus)
  misc_feature (36): n=a or g
aaataattaaaagccaggcaacatggcacttaatcnatagcagagttataggtgcaaacagcagaaatggc

SEQ ID NO: 39718 - DNA, 71 bp, chicken (Gallus Gallus)
  misc_feature (36): n=a or g
aaaggagagtgccactgccaaaggttaatgtgcagngttgattgtgcatgaggctgattagccttaagcat

SEQ ID NO: 39719 - DNA, 71 bp, chicken (Gallus Gallus)
  misc_feature (36): n=g or t
gaatttggttgaccactagatggccaattgtcacancaatctcaattgttagcttttttgtttgtatttca

SEQ ID NO: 39720 - DNA, 71 bp, chicken (Gallus Gallus)
  misc_feature (36): n=c or t
aactgagttagaaagctactcaacactgacagatangcctttgtagcaaattctgcatcccatgctgttag

SEQ ID NO: 39721 - DNA, 71 bp, chicken (Gallus Gallus)
  misc_feature (36): n=a or g
tctctggagtccattctgtttccaaacttgcaggangttgtttctggcaacctttcaacattatttgttgt

SEQ ID NO: 39722 - DNA, 71 bp, chicken (Gallus Gallus)
  misc_feature (36): n=c or t
aaccactcctgtgaacactgatccaaacactgctcngtgctgttcccaacacaacaggcaatgcccgggtt

SEQ ID NO: 39723 - DNA, 71 bp, chicken (Gallus Gallus)
  misc_feature (36): n=c or t
tactcattcctttctggcacctcccttgagcaccancttgcaccaaaacccacagcaagccactcagtctc

SEQ ID NO: 39724 - DNA, 71 bp, chicken (Gallus Gallus)
  misc_feature (36): n=a or g
tcttttgggagcaaagcatgagctgccaggaaatanggaagcttgtctgacaacgcctagaacctttacgc

SEQ ID NO: 39725 - DNA, 71 bp, chicken (Gallus Gallus)
  misc_feature (36): n=c or t
gggtgctggcaggctcgagcagcgtcacaaagatgngtcagatcaagtcagtgcaagcatcagatgcaatg

SEQ ID NO: 39726 - DNA, 71 bp, chicken (Gallus Gallus)
  misc_feature (36): n=c or t
actcggagaacatctggtaaatatcttaattacacngtgcctcactatacaaagcagagggtgattcggat

SEQ ID NO: 39727 - DNA, 71 bp, chicken (Gallus Gallus)
  misc_feature (36): n=g or t
gaaaaatgcatggttataaagagcagtacacttttnttatatctatcaacactgtagcttcttctgaggac

SEQ ID NO: 39728 - DNA, 71 bp, chicken (Gallus Gallus)
  misc_feature (36): n=c or t
ccaacccagactcatgctattgaagctcctctcacntgctagaggggttttcttgatttgcaaaggatgag

SEQ ID NO: 39729 - DNA, 71 bp, chicken (Gallus Gallus)
  misc_feature (36): n=a or c
cgttattactcacacatctctgactgcccaaactgntcttaaagcactttggcatgtcccaagggtcatta

SEQ ID NO: 39730 - DNA, 71 bp, chicken (Gallus Gallus)
  misc_feature (36): n=c or t
tccaccacactagctccagtctggtcccacccacantcagagcaggtttgactccatcccaaagggatctg

SEQ ID NO: 39731 - DNA, 71 bp, chicken (Gallus Gallus)
  misc_feature (36): n=a or g
tgaactcaacaggactttcccattaggcactgtatnagttctggtgattgatccttccttggcagagtggg

SEQ ID NO: 39732 - DNA, 71 bp, chicken (Gallus Gallus)
  misc_feature (36): n=a or g
ttactatctgcagaattgggcattggaggagactcnaactgacatctttttcctgacagatgttagcaata

SEQ ID NO: 39733 - DNA, 71 bp, chicken (Gallus Gallus)
  misc_feature (36): n=c or t
cactgaacgtctgttaagactgaagggactgtgctnttcaaattaagattttcactaagaatgaatccata

SEQ ID NO: 39734 - DNA, 71 bp, chicken (Gallus Gallus)
  misc_feature (36): n=c or t
ttagggcagcttaatggcttagtattttcatggtgngtagaccagcattaatcatgtggagggggatatca

SEQ ID NO: 39735 - DNA, 71 bp, chicken (Gallus Gallus)
  misc_feature (36): n=c or t
caagctgctttgtgcattcagaggcaagaaagagtngtgttgctcaagagcttaggctaaaaagagcttaa

SEQ ID NO: 39736 - DNA, 71 bp, chicken (Gallus Gallus)
  misc_feature (36): n=a or g
cgcaacttttatgcttaacacagagtaatctcctcngtgggagagggatttcttcatttcctacaccaaag

SEQ ID NO: 39737 - DNA, 71 bp, chicken (Gallus Gallus)
  misc_feature (36): n=c or t
caaggatcttccttgaagaaatcagccgaggctcanaggtaggtaaaaagacatgccaaataaaagagagg

SEQ ID NO: 39738 - DNA, 71 bp, chicken (Gallus Gallus)
  misc_feature (36): n=a or g
gggcaaatgcttcgagtacattcccacatatttccngatagagtgatggagatgagtgagatccacgtatt

SEQ ID NO: 39739 - DNA, 71 bp, chicken (Gallus Gallus)
  misc_feature (36): n=a or c
attgaaggtctgaaaggtatctaaaaacccataacntttgttagtataacattttcccacttagatgccac

SEQ ID NO: 39740 - DNA, 71 bp, chicken (Gallus Gallus)
  misc_feature (36): n=c or t
accagtacagcccttttctttatgaactaatcctgntgctagtaataggattagcatcaagaacagatgca

SEQ ID NO: 39741 - DNA, 71 bp, chicken (Gallus Gallus)
  misc_feature (36): n=g or t
acaactataatacctatatgtcaggcttgcttgcantctgctctctgaaattcctcctgtcctgttctttg

SEQ ID NO: 39742 - DNA, 71 bp, chicken (Gallus Gallus)
  misc_feature (36): n=g or t
gcaggcaaagagaaaacagtgagtgggtgctcagcngggcaggcagtagaaaagtgaagtaggaaggtgtt

SEQ ID NO: 39743 - DNA, 71 bp, chicken (Gallus Gallus)
  misc_feature (36): n=c or t
agggaaatgaaaagagttgcctaaagctcagcaganggatccacatctttgctatactttgctaccgaagt

SEQ ID NO: 39744 - DNA, 71 bp, chicken (Gallus Gallus)
  misc_feature (36): n=a or g
atttaagagcctatttctcccattgcacttttattntaagcaggtactgaaacaaaaaccatcaaccacca

SEQ ID NO: 39745 - DNA, 71 bp, chicken (Gallus Gallus)
  misc_feature (36): n=c or t
taccaatatgagagccactcttgtgaaaagggcagngtgggtttcactctcagttatgtttgggctccttt

SEQ ID NO: 39746 - DNA, 71 bp, chicken (Gallus Gallus)
  misc_feature (36): n=a or g
caggtataaaagaatgtgatccaaaggcactggaangtctgtgcatggatgctccattacccagagaacga

SEQ ID NO: 39747 - DNA, 71 bp, chicken (Gallus Gallus)
  misc_feature (36): n=a or g
cagaaatctcatctcttccacttggtttgtgagcantaattcccctaaatgtaactgccttctcatttagc

SEQ ID NO: 39748 - DNA, 71 bp, chicken (Gallus Gallus)
  misc_feature (36): n=a or g
tctttgaaagcttactgaatctatttctccaatggnaaactaggttgattctcctatagctcccacagtat

SEQ ID NO: 39749 - DNA, 71 bp, chicken (Gallus Gallus)
  misc_feature (36): n=a or c
tgcattacctggacaaggtcttgctcagacccttcncactgcactgtgcacatgcgtatcccacagatggt

SEQ ID NO: 39750 - DNA, 71 bp, chicken (Gallus Gallus)
  misc_feature (36): n=c or t
atttccataccctagcctaacgaagaaaaaggcccnttcagagcagcttttaggcataccatttaaaaaca

SEQ ID NO: 39751 - DNA, 71 bp, chicken (Gallus Gallus)
  misc_feature (36): n=c or t
aaactgctatctttacaactccctgcttggagggcntctgacagctgatagcagtaaattgaggcaaaaat

SEQ ID NO: 39752 - DNA, 71 bp, chicken (Gallus Gallus)
  misc_feature (36): n=a or g
tcaaggtgaagtctgaagaaaaacagactgtcctcnaaggcttgcagggataaaactacatcaggtttcta

SEQ ID NO: 39753 - DNA, 71 bp, chicken (Gallus Gallus)
  misc_feature (36): n=a or g
gcgacgcactcaacattcacagatgcctggaacacncaaataaagcaactgtcaagaaaaatcataatttt

SEQ ID NO: 39754 - DNA, 71 bp, chicken (Gallus Gallus)
  misc_feature (36): n=a or c
taaaggcatcctgtggtgtatttcagttctcatagntgtgtattttcagatgacaaaatgtgccactatcc

SEQ ID NO: 39755 - DNA, 71 bp, chicken (Gallus Gallus)
  misc_feature (36): n=a or c
agattgtactgagttattttcccttttattgaagangttaattcttgaggattttactgtcaagcagccaa

SEQ ID NO: 39756 - DNA, 71 bp, chicken (Gallus Gallus)
  misc_feature (36): n=c or t
tggacctctgaccatcacaccaactgttgctctcancggcctctctggtttccaagcagcgggagaaagag

SEQ ID NO: 39757 - DNA, 71 bp, chicken (Gallus Gallus)
  misc_feature (36): n=g or t
tgggtaaaaatcaatcttccccaggctacaagatgncattgttctctagacgtggttagacttgatcgcat

SEQ ID NO: 39758 - DNA, 71 bp, chicken (Gallus Gallus)
  misc_feature (36): n=c or t
caggtctatgcttggctttctcaaaccataacacgntcaattcaagcatctgggaggagcttttagcattc

SEQ ID NO: 39759 - DNA, 71 bp, chicken (Gallus Gallus)
  misc_feature (36): n=a or g
ttttgcatgcatgtgaagatactacaaccatgccangaggaaagcactcatcaggggtgcacggcgtgtcc

SEQ ID NO: 39760 - DNA, 71 bp, chicken (Gallus Gallus)
  misc_feature (36): n=a or g
agagaattcaagcaagctcagaaatgttggattacncaggtatggaaaacactgctgagcaaatcagtagc

SEQ ID NO: 39761 - DNA, 71 bp, chicken (Gallus Gallus)
  misc_feature (36): n=a or c
ggctataaagaaacatgaatcaagcaagagattaanaaagcacagaacagtgtcagagccagcagcaccca

SEQ ID NO: 39762 - DNA, 71 bp, chicken (Gallus Gallus)
  misc_feature (36): n=a or g
aagtggatggggtgtagttgagagtggtgtagaagngtaattcatttctatatgatgcttcccaaatgaaa

SEQ ID NO: 39763 - DNA, 71 bp, chicken (Gallus Gallus)
  misc_feature (36): n=a or g
ctctgtactttgtcatgagcttcctcactgacttgnggttatgcacgtcacttctggaagctcttcagctt

SEQ ID NO: 39764 - DNA, 71 bp, chicken (Gallus Gallus)
  misc_feature (36): n=a or g
tggaaaggagccgtgagctgtgctgttagtcacaangctgctaggaaacatggaaatgggactgacgttgc

SEQ ID NO: 39765 - DNA, 71 bp, chicken (Gallus Gallus)
  misc_feature (36): n=c or t
gtatgtggaccatgttgcacgtatgcatagaaacgngttgtatgtcttcaagagatgatgtgggctggatt

SEQ ID NO: 39766 - DNA, 71 bp, chicken (Gallus Gallus)
  misc_feature (36): n=c or t
atggtgtactttttgctagcttctgcatagtcagcngactacctacaaacacatgaagactgtgcttcgca

SEQ ID NO: 39767 - DNA, 71 bp, chicken (Gallus Gallus)
  misc_feature (36): n=a or g
cttccctgggatgcattgggctgtgcccctcgctgngcgttgttaattggatgagtgctgtttcccgaatg

SEQ ID NO: 39768 - DNA, 71 bp, chicken (Gallus Gallus)
  misc_feature (36): n=a or g
tggatttgggagggggaaatacacaccttgatgtcnagtttatggttgatagccagtgcagaatgttccag

SEQ ID NO: 39769 - DNA, 71 bp, chicken (Gallus Gallus)
  misc_feature (36): n=a or g
tcgtgcctccatctgtggatctcccccacagcagcnggtcaggagttgtccctgggccccacacacctctc

SEQ ID NO: 39770 - DNA, 71 bp, chicken (Gallus Gallus)
  misc_feature (36): n=a or g
accagcagatgggcccactccttctcctaaaattgncccaggaagctcagaagctctgattggtggctctg

SEQ ID NO: 39771 - DNA, 71 bp, chicken (Gallus Gallus)
  misc_feature (36): n=c or t
actgttcaaaaggcaagcagcccttctccttgctcnctgtcttcctctccatttaagcacacagacacaaa

SEQ ID NO: 39772 - DNA, 71 bp, chicken (Gallus Gallus)
  misc_feature (36): n=c or t
aaccattgcaattgtccttccaaacagatcctgcanagctcatcagtgggtgctgggagaaaggagaaccc

SEQ ID NO: 39773 - DNA, 71 bp, chicken (Gallus Gallus)
  misc_feature (36): n=c or t
tgtaactatataatttagcacttgctacttatgtgnctgtcgcattgtttaccattactaagagttggatt

SEQ ID NO: 39774 - DNA, 71 bp, chicken (Gallus Gallus)
  misc_feature (36): n=c or t
cccagttccacttttggggtcagatttcaccttggnatgtcccagtcccaccctggggtgagcttataatg

SEQ ID NO: 39775 - DNA, 71 bp, chicken (Gallus Gallus)
  misc_feature (36): n=g or t
ttctttttcttgcagcttaagcagtgccagaagtgnggttgcagattcctctgtaggtctgctttatcgaa

SEQ ID NO: 39776 - DNA, 71 bp, chicken (Gallus Gallus)
  misc_feature (36): n=c or t
cttctttgatttatttttgactttaacactatatantgcagttcagctatgtagtcacattcctttgtttg

SEQ ID NO: 39777 - DNA, 71 bp, chicken (Gallus Gallus)
  misc_feature (36): n=c or t
aggagaatagccttgggatccctccagttcagcttnctgggttagtttcaagctcaaagggctctcctctc

SEQ ID NO: 39778 - DNA, 71 bp, chicken (Gallus Gallus)
  misc_feature (36): n=a or g
gcacccagagactgtatctcatcagcacttaaacangtgctgccccattagtcaacacatacataaaagtc

SEQ ID NO: 39779 - DNA, 71 bp, chicken (Gallus Gallus)
  misc_feature (36): n=g or t
acgtcactcattccagcagaggtaaatgactgaggngctcttgatgctaactgcaattgtaagggtaaaag

SEQ ID NO: 39780 - DNA, 71 bp, chicken (Gallus Gallus)
  misc_feature (36): n=c or t
ctatgtgctgacactgtttggagaaggctgcagagnaggatttctgcactgccctgttggctgctgctatg

SEQ ID NO: 39781 - DNA, 71 bp, chicken (Gallus Gallus)
  misc_feature (36): n=a or c
gacggtgttggaaaggatatccaaggatgcaaagtncctgcagcagtattacgagtttaactccgtcagat

SEQ ID NO: 39782 - DNA, 71 bp, chicken (Gallus Gallus)
  misc_feature (36): n=a or c
ctgtgttatgctggggctgcatcttccctctgcggntgcaaagagaggagggtggtgttgctcagctttaa

SEQ ID NO: 39783 - DNA, 71 bp, chicken (Gallus Gallus)
  misc_feature (36): n=a or c
tctttgagcaaaacagctcccactgagcctagaaanagggcaagatttcttctagatagatctaacacaca

SEQ ID NO: 39784 - DNA, 71 bp, chicken (Gallus Gallus)
  misc_feature (36): n=a or c
ggtacccttgctggtgaggattctgctgctgtgagncttgctatcacactcagcactccttcctctagagg

SEQ ID NO: 39785 - DNA, 71 bp, chicken (Gallus Gallus)
  misc_feature (36): n=a or g
aaaaataactgcagaattctctctaatgtgacagtngtcttcacagaggcgtttttaatagcttaagcacc

SEQ ID NO: 39786 - DNA, 71 bp, chicken (Gallus Gallus)
  misc_feature (36): n=c or t
aggacacggatacacacaccatgcttcttcaggttntccctacacccaacaagaagagtgaggattgcaga

SEQ ID NO: 39787 - DNA, 71 bp, chicken (Gallus Gallus)
  misc_feature (36): n=c or t
ggactaatgacattgccatggtcgggcagcaaactngattcccagcttgcaaggttctgtgggaagaggaa

SEQ ID NO: 39788 - DNA, 71 bp, chicken (Gallus Gallus)
  misc_feature (36): n=a or g
cttcctgccaaagccctgagagagcagaaaaactcntaaggatgttggacaaagcccactctcatcttctc

SEQ ID NO: 39789 - DNA, 71 bp, chicken (Gallus Gallus)
  misc_feature (36): n=c or t
gtcacagggctggcctgcttgctagcatctgaatancaccagctgcagaacagggaaacagccacacacat

SEQ ID NO: 39790 - DNA, 71 bp, chicken (Gallus Gallus)
  misc_feature (36): n=c or t
tcatcgatctggtggacgctgaagagctctgtcagnttcttgaagatcaggacgtcgatctccctgctgga

SEQ ID NO: 39791 - DNA, 71 bp, chicken (Gallus Gallus)
  misc_feature (36): n=c or t
gccaaagacaacagttctgagttgctctaatcctgnggacctcttccctccacaggacaccttccagtgaa

SEQ ID NO: 39792 - DNA, 71 bp, chicken (Gallus Gallus)
  misc_feature (36): n=c or t
gtttactctgcgtaatccttttgctggacactctcntgcttggtcccacgtatcagaacatgattacgtat

SEQ ID NO: 39793 - DNA, 71 bp, chicken (Gallus Gallus)
  misc_feature (36): n=c or t
gctcctgcctgctccccgcctgagttttggaggcangcggacatcctgacctagagacatatgtggggagg

SEQ ID NO: 39794 - DNA, 71 bp, chicken (Gallus Gallus)
  misc_feature (36): n=a or g
atctgagcatcgcctgggggcactccagggccatgnctgttgggacagctcatgcaatgcagctatggtgg

SEQ ID NO: 39795 - DNA, 71 bp, chicken (Gallus Gallus)
  misc_feature (36): n=a or g
tattgtttgcctttcctcccagccaccacgtgagtngttcagctgggacctgattgtgctgtatggggtcc

SEQ ID NO: 39796 - DNA, 71 bp, chicken (Gallus Gallus)
  misc_feature (36): n=a or g
aacctgccaccttttacatctctaacaaaatttccnttgttcagagtaacttctggcagtgaaatactttt

SEQ ID NO: 39797 - DNA, 71 bp, chicken (Gallus Gallus)
  misc_feature (36): n=a or g
ctgagttacaacatccccttggctgggaagagagcngagttttcttgccagatctagtttcattgtgttgt

SEQ ID NO: 39798 - DNA, 71 bp, chicken (Gallus Gallus)
  misc_feature (36): n=c or t
taaaggtgttctgcattggaagagaactgctgcgtngcttgttttcatgtcttacccattttcaggcccct

SEQ ID NO: 39799 - DNA, 71 bp, chicken (Gallus Gallus)
  misc_feature (36): n=a or g
gcaatctgggtgatgctccctgccagacaggcaacntcagccctctctgcagcaccagcccggaatccctg

SEQ ID NO: 39800 - DNA, 71 bp, chicken (Gallus Gallus)
  misc_feature (36): n=a or g
ctttcaatcacagtcattttttggcacgaaggcacnatagcagtcccagggactgacataggcagaggcat

SEQ ID NO: 39801 - DNA, 71 bp, chicken (Gallus Gallus)
  misc_feature (36): n=a or c
taaaagctgtgtctctcataaagtcattaagctgtnaagtcattaagtaattgtgaggcttattttggttc

SEQ ID NO: 39802 - DNA, 71 bp, chicken (Gallus Gallus)
  misc_feature (36): n=a or c
gctagcttaaaaagtaatgactcaagtgccactttnctttatttactactcttctgctttcaggagttagg

SEQ ID NO: 39803 - DNA, 71 bp, chicken (Gallus Gallus)
  misc_feature (36): n=c or t
tgcagattaaataccaaatgttttacatatgttatntctgggagccaactgtagtatttgtgaacccactt

SEQ ID NO: 39804 - DNA, 71 bp, chicken (Gallus Gallus)
  misc_feature (36): n=g or t
aaactttaaacacactgctccacttttctccacttncaatgctttgatctatatgccactccatttttaat

SEQ ID NO: 39805 - DNA, 71 bp, chicken (Gallus Gallus)
  misc_feature (36): n=a or g
tgacagttctgacttttaagatgatacttcaggaancagaatggaactcgcagagcattttgatgtcccta

SEQ ID NO: 39806 - DNA, 71 bp, chicken (Gallus Gallus)
  misc_feature (36): n=a or g
gctgtgcaggggccacccatgcagtggaagggaaangctctgaaagaggagctcagctccatggtacatgg

SEQ ID NO: 39807 - DNA, 71 bp, chicken (Gallus Gallus)
  misc_feature (36): n=g or t
aacatgggctgcgcatggttttctggctttgttcantcccacatctgattgcttttgatgcagcagcgctc

SEQ ID NO: 39808 - DNA, 71 bp, chicken (Gallus Gallus)
  misc_feature (36): n=g or t
caccccgcagcgcatcggggtcccccttctgccccnctgacaaagggtgaattcagccctggagggcagtg

SEQ ID NO: 39809 - DNA, 71 bp, chicken (Gallus Gallus)
  misc_feature (36): n=a or g
ttagcatgagatctaattgcagtgtcttttgggtcngtgaagaagttgcgtttgctgctttgagtgcctat

SEQ ID NO: 39810 - DNA, 71 bp, chicken (Gallus Gallus)
  misc_feature (36): n=a or g
gtttaattcccccgggttctctgttgtgcagaaagnggttgtttcggtttggtttgcagtgggagagatat

SEQ ID NO: 39811 - DNA, 71 bp, chicken (Gallus Gallus)
  misc_feature (36): n=a or g
gcatggaggttcactgagaggcagacctgagctgtngtgttcaaagagactttaggtttgctttcctgttc

SEQ ID NO: 39812 - DNA, 71 bp, chicken (Gallus Gallus)
  misc_feature (36): n=a or g
cttgtctgtgagtactgtgcctttgaaaagggaaancatggctggggtgcagagtgccagccggctgcctt

SEQ ID NO: 39813 - DNA, 71 bp, chicken (Gallus Gallus)
  misc_feature (36): n=c or t
ccgtcttcttggccaaggtggtgatgattgatgttnaaaaccttggattttggaggagcatttgtgattgt

SEQ ID NO: 39814 - DNA, 71 bp, chicken (Gallus Gallus)
  misc_feature (36): n=a or g
ctcttgcaggtcctagctcaggccataaaggcagcnaaggagcagcacccggacatgtcggtgaccaaagt

SEQ ID NO: 39815 - DNA, 71 bp, chicken (Gallus Gallus)
  misc_feature (36): n=g or t
tttgttgcttgagatttgcagctgcctgggcaatangaagtgggcagcagcaccaacacctgcagctcccc

SEQ ID NO: 39816 - DNA, 71 bp, chicken (Gallus Gallus)
  misc_feature (36): n=c or t
aaggaattaaagatatgagtttcaggatgactgcgngttcccagcacgaggctgtcaagctgtgaccattt

SEQ ID NO: 39817 - DNA, 71 bp, chicken (Gallus Gallus)
  misc_feature (36): n=a or g
ttgtagggagcagagagatggatttgggaagagctncacatgcttagtaatgcaatctgtctgccacctca

SEQ ID NO: 39818 - DNA, 71 bp, chicken (Gallus Gallus)
  misc_feature (36): n=c or t
gagaatctagctatatttggaaaaagacccagcaanagatgagtgcacattcttgcttgctctgcaaagac

SEQ ID NO: 39819 - DNA, 71 bp, chicken (Gallus Gallus)
  misc_feature (36): n=a or g
acacttttccatccaagtttcttaatttcctctctncaaaaggggaagtgggagttgtgtaaacaaaacca

SEQ ID NO: 39820 - DNA, 71 bp, chicken (Gallus Gallus)
  misc_feature (36): n=a or c
aagaattgcattcacagaagtgaggcatggacatcnaagggttaacagatctttccccttcctttataaag

SEQ ID NO: 39821 - DNA, 71 bp, chicken (Gallus Gallus)
  misc_feature (36): n=a or g
aggcagggagaaaaccaaacagggaaacatgcaagnccaacagtgctcgaagagttctgcccaaagagtca

SEQ ID NO: 39822 - DNA, 71 bp, chicken (Gallus Gallus)
  misc_feature (36): n=a or g
gaaggaattgcaaacattcagtgcctaagatgttcnagcagtaaccaagaaccgaacatctccagcttcaa

SEQ ID NO: 39823 - DNA, 71 bp, chicken (Gallus Gallus)
  misc_feature (36): n=a or g
tttttttagctacaatataatgagaactgaaacatngaaggagacttaggaaacagcaaagaaaagaaacc

SEQ ID NO: 39824 - DNA, 71 bp, chicken (Gallus Gallus)
  misc_feature (36): n=c or t
tggtgggagaaggggaacttccccagctcagcctcntcctttccccacaggagcagtacatcttcatccac

SEQ ID NO: 39825 - DNA, 71 bp, chicken (Gallus Gallus)
  misc_feature (36): n=c or t
aatgtgttgtgatattaaacacttccagtaacactngagtcttaatttaatggagaccaaggggaaaaaaa

SEQ ID NO: 39826 - DNA, 71 bp, chicken (Gallus Gallus)
  misc_feature (36): n=c or t
cacgaaaatcctgcttgggaagtttggaaagagttncagacggaggcaaaggcagaaccaggctgaaagca

SEQ ID NO: 39827 - DNA, 71 bp, chicken (Gallus Gallus)
  misc_feature (36): n=a or g
cctgttagctgcaccccccacttcagggcactcacnggtgggaggctttgctttttgaaggcttcccctct

SEQ ID NO: 39828 - DNA, 71 bp, chicken (Gallus Gallus)
  misc_feature (36): n=a or g
ccttgcatgtaaaggggagatgctgcaggctgccancagtgctgcaaggtgggtgggtgggagcagggcac

SEQ ID NO: 39829 - DNA, 71 bp, chicken (Gallus Gallus)
  misc_feature (36): n=a or g
ctgaggagctctgatcttttgggctggggtccttcntgcatcttagctgcaagcacactgctctcagctcg

SEQ ID NO: 39830 - DNA, 71 bp, chicken (Gallus Gallus)
  misc_feature (36): n=a or g
gaaaaaaatgagagcacagggaagaatgatgcatgntgagggctgaatcccaaggttggatccattgcctc

SEQ ID NO: 39831 - DNA, 71 bp, chicken (Gallus Gallus)
  misc_feature (36): n=a or g
agcttataatcaacctgcccgattttaaactcgtcnggagctgagctacaggtttttaatttattattact

SEQ ID NO: 39832 - DNA, 71 bp, chicken (Gallus Gallus)
  misc_feature (36): n=a or g
taagggaaagaagcaaaactgcatccagaatggatntgaccttgttaacccttatcaataattgatgcctc

SEQ ID NO: 39833 - DNA, 71 bp, chicken (Gallus Gallus)
  misc_feature (36): n=c or t
cagcaaagtgcttgcaattgaacagaactgtatttntgacccaaaatcacagcttggaaatgttctggctc

SEQ ID NO: 39834 - DNA, 71 bp, chicken (Gallus Gallus)
  misc_feature (36): n=c or t
acgcatacaaatcaatggcgaggttctgctttgcanttccagtgggttctctggtgtttcggatgttgagt

SEQ ID NO: 39835 - DNA, 71 bp, chicken (Gallus Gallus)
  misc_feature (36): n=g or t
tatttcctggagcctgatagcctcagcaagcccatntctgtcctaaggcaaggaatggagtagcagaaagc

SEQ ID NO: 39836 - DNA, 71 bp, chicken (Gallus Gallus)
  misc_feature (36): n=a or c
acgtaacagggacagtaaggacactgctttctctgnacagtcagacacatcacatctggttcttgagatgc

SEQ ID NO: 39837 - DNA, 71 bp, chicken (Gallus Gallus)
  misc_feature (36): n=c or t
gatatcggtgcgctcgtgattaactcaaggcacttngctgctctgcacttacaagaacgtctacataatga

SEQ ID NO: 39838 - DNA, 71 bp, chicken (Gallus Gallus)
  misc_feature (36): n=c or t
agtaatcccaggtgccttgaaatgccacttttttantacaactgcaaagctcttaggaattgcagctgacc

SEQ ID NO: 39839 - DNA, 71 bp, chicken (Gallus Gallus)
  misc_feature (36): n=a or g
caaaacactccagatcttgaagtaggaagagatatnaattctagctctttcctctctacattgccacattt

SEQ ID NO: 39840 - DNA, 71 bp, chicken (Gallus Gallus)
  misc_feature (36): n=g or t
gggtatgaatcgtgcagcgtacaacttcagggagtntggctttttcatagccaagcagctgaagtcaaatg

SEQ ID NO: 39841 - DNA, 71 bp, chicken (Gallus Gallus)
  misc_feature (36): n=a or g
gaagcagacattcagctccaggtgtaggaatcgacnttttacccttctctatttgaaatctgggcttgctc

SEQ ID NO: 39842 - DNA, 71 bp, chicken (Gallus Gallus)
  misc_feature (36): n=a or g
agtcctcacttgtaacgaacccagttaaaacatganaatgagcagatctccacttccagagcacaagaggt

SEQ ID NO: 39843 - DNA, 71 bp, chicken (Gallus Gallus)
  misc_feature (36): n=a or g
ggacagcgtgaggggtctgacggcactgctcagtgncagaggtgcagtaggagggggacagacaggggggt

SEQ ID NO: 39844 - DNA, 71 bp, chicken (Gallus Gallus)
  misc_feature (36): n=c or t
tatgggtttggctcacaaaacagttaggaagggttngtgtccgtggtgtctgacacagagctcatccacat

SEQ ID NO: 39845 - DNA, 71 bp, chicken (Gallus Gallus)
  misc_feature (36): n=a or c
cttttgctaaagcacagccttgcactacatggaagnatggggaatgaatgaaatatggctgcaaactaagt

SEQ ID NO: 39846 - DNA, 71 bp, chicken (Gallus Gallus)
  misc_feature (36): n=c or t
aaatagttgaatttatgctgagttatctacaaatanactatttttgcctgtggcctaaaatcatgttggct

SEQ ID NO: 39847 - DNA, 71 bp, chicken (Gallus Gallus)
  misc_feature (36): n=g or t
agaaactgcataagttctgcatgtttcttactctgntttggatgttcaaataagaaaggaatactaacgat

SEQ ID NO: 39848 - DNA, 71 bp, chicken (Gallus Gallus)
  misc_feature (36): n=a or g
atggggcacagaatgaggatgaagaggtaagtgcanaagctgttctctggcacgttgttcctttgttaagt

SEQ ID NO: 39849 - DNA, 71 bp, chicken (Gallus Gallus)
  misc_feature (36): n=c or t
cgtacacacaagctaatgctgggcaaattgctgctnctgttatgatctgatagctgaattgcttctccaaa

SEQ ID NO: 39850 - DNA, 71 bp, chicken (Gallus Gallus)
  misc_feature (36): n=a or g
gctgcatcccaaaacgctcagggagatccatcccanaagcaggtgtgattttgccttgtagaaaaaaaaga

SEQ ID NO: 39851 - DNA, 71 bp, chicken (Gallus Gallus)
  misc_feature (36): n=c or t
cttggtgattctccaattctaccattttccatttanctgatccccaaataatcttttacatcacggagtcc

SEQ ID NO: 39852 - DNA, 71 bp, chicken (Gallus Gallus)
  misc_feature (36): n=c or t
tcaagttctgcaagatgataactggagcctatttcngtggctgaaggcctcatcatctccgacagctcaag

SEQ ID NO: 39853 - DNA, 71 bp, chicken (Gallus Gallus)
  misc_feature (36): n=a or g
agcacagctcttcttgcagggtcccgcaagctggantacaatggacaaacctggcacgagcactgcttcat

SEQ ID NO: 39854 - DNA, 71 bp, chicken (Gallus Gallus)
  misc_feature (36): n=g or t
ggaaaggctttatccctgacaatgatgagatcctgngccgtgactgcagcaacgacctatgagccttggag

SEQ ID NO: 39855 - DNA, 71 bp, chicken (Gallus Gallus)
  misc_feature (36): n=a or g
aatgtgctgcaagaacattggcatttgctagctctngccaaaaatgtattacctcatactggtgactaatt

SEQ ID NO: 39856 - DNA, 71 bp, chicken (Gallus Gallus)
  misc_feature (36): n=c or t
ctgcatttttttcccctgctgtgcgactagtttgangctatgagttcatttcagcaggagctgcgctcccg

SEQ ID NO: 39857 - DNA, 71 bp, chicken (Gallus Gallus)
  misc_feature (36): n=a or g
ttacaagaagtaatgtttaaacaaagtattgatgcngaagaatatatttgcctttaaaaggacttgttttt

SEQ ID NO: 39858 - DNA, 71 bp, chicken (Gallus Gallus)
  misc_feature (36): n=a or g
tcccagtgcggcaccaaggcgtgatcccagtgcagntagcggccctcgaagcgcgggctgccgtaccaggc

SEQ ID NO: 39859 - DNA, 71 bp, chicken (Gallus Gallus)
  misc_feature (36): n=c or t
tgtgtatgcagggagctccatagcgagctgaaactnctgttttctccaaaccttataatgaaaaccgatac

SEQ ID NO: 39860 - DNA, 71 bp, chicken (Gallus Gallus)
  misc_feature (36): n=a or g
gagccagccctgggagctgggagcctaattaaggcntgtaatgaatctgcagaaggagctggcccgccaca

SEQ ID NO: 39861 - DNA, 71 bp, chicken (Gallus Gallus)
  misc_feature (36): n=a or g
aatttctggcaggagtagtgcgttacctggcccatncacagaatggtgtcagacagaggagagatttgctg

SEQ ID NO: 39862 - DNA, 71 bp, chicken (Gallus Gallus)
  misc_feature (36): n=c or t
atgcgggcctttaattttaacaagcatttcaaatgnagtgcttgaatagcatcacttacagcactattttt

SEQ ID NO: 39863 - DNA, 71 bp, chicken (Gallus Gallus)
  misc_feature (36): n=a or g
atgccgttacccaaatgggaacacaaaggccaggcngaagaggtagtgtacattagagggaagttttcaat

SEQ ID NO: 39864 - DNA, 71 bp, chicken (Gallus Gallus)
  misc_feature (36): n=a or g
gcctttccacacaaccagagcttacagaacagtacntagatctttaatctcacagcgcagtgagctctgtg

SEQ ID NO: 39865 - DNA, 71 bp, chicken (Gallus Gallus)
  misc_feature (36): n=a or c
ggtgggactgtcctaccacagccacccttggattcntggcctgggaggttccagatgtccgcagccatttt

SEQ ID NO: 39866 - DNA, 71 bp, chicken (Gallus Gallus)
  misc_feature (36): n=c or t
ttccagtcattttttgctgagttgccttttccaggntgcatttgccaaggggggattttcctcctttgcat

SEQ ID NO: 39867 - DNA, 71 bp, chicken (Gallus Gallus)
  misc_feature (36): n=a or c
ccttttacatctttaattgcaaaatgctgggttttnccatcactaattagaactgcattcctttactaacc

SEQ ID NO: 39868 - DNA, 71 bp, chicken (Gallus Gallus)
  misc_feature (36): n=a or g
acactgaactgatgcggtgtcccagagcctgatctnagaggaagagacatttctccatcacacctgatata

SEQ ID NO: 39869 - DNA, 71 bp, chicken (Gallus Gallus)
  misc_feature (36): n=c or t
ataacaatgggcttcaggttatcgctctccttctcntccaaaggtggcacaggtgcaggggtcttgttggc

SEQ ID NO: 39870 - DNA, 71 bp, chicken (Gallus Gallus)
  misc_feature (36): n=a or g
aattagatttttctcagtcttccacctagaggactnaagaagcatttacacatttgtccaaaccctctgct

SEQ ID NO: 39871 - DNA, 71 bp, chicken (Gallus Gallus)
  misc_feature (36): n=a or g
ttttttattttttccaaagtatgcagagttctgttngcatctggaaaatgctgatgtgggagctctgctca

SEQ ID NO: 39872 - DNA, 71 bp, chicken (Gallus Gallus)
  misc_feature (36): n=a or g
tattttctaattgttattaagttcctgccatcatcntggccaaaatgctgaacattttcttacttttgctt

SEQ ID NO: 39873 - DNA, 71 bp, chicken (Gallus Gallus)
  misc_feature (36): n=a or g
cccgtgaagggtgattacatctcctccccgtgtaangaggaccttaaataacagcgggtcttacagctttg

SEQ ID NO: 39874 - DNA, 71 bp, chicken (Gallus Gallus)
  misc_feature (36): n=a or g
aggaagagctaaaagcgctccttctctcacatgtanaacagaaatatttaatctacacatctaaacataac

SEQ ID NO: 39875 - DNA, 71 bp, chicken (Gallus Gallus)
  misc_feature (36): n=c or t
gagctttctcctttgaagagctcagggaagagatgnctgtcactgcagctcatggaaactttgctgcatta

SEQ ID NO: 39876 - DNA, 71 bp, chicken (Gallus Gallus)
  misc_feature (36): n=c or t
tcggcgctttgatccgctcttggccggggctgctgngagggcacagagctcaccccgtgcaaacgaggagc

SEQ ID NO: 39877 - DNA, 71 bp, chicken (Gallus Gallus)
  misc_feature (36): n=c or t
tcattatttctaagggtcgtctcataaatccttctngtctctattattcactccggccctggaaagccgca

SEQ ID NO: 39878 - DNA, 71 bp, chicken (Gallus Gallus)
  misc_feature (36): n=c or t
gctgctagaatagaatgcactccgttgcccatcttnccctctgcagtggtcagaaggcagaggtgggcatc

SEQ ID NO: 39879 - DNA, 71 bp, chicken (Gallus Gallus)
  misc_feature (36): n=a or g
ctgctggctagaaacaacaagtgcaatctcatggcnctgaaacaggaacaaagagtaatccaaaagtactt

SEQ ID NO: 39880 - DNA, 71 bp, chicken (Gallus Gallus)
  misc_feature (36): n=a or g
ggacgtagcttaaattctgcatgtgcacagttgtcnggttgctgcctaaattaagctggtaaatagctgta

SEQ ID NO: 39881 - DNA, 71 bp, chicken (Gallus Gallus)
  misc_feature (36): n=a or c
gctgggacagccctcagcacatggggcacgtgaacnaatgtcagatcagccctgctggaaatacaccccca

SEQ ID NO: 39882 - DNA, 71 bp, chicken (Gallus Gallus)
  misc_feature (36): n=a or g
tataaataatgaactaatctcatcttcaaggcatcnctttgccgtttaggccttaaaaagaaaaggggggg

SEQ ID NO: 39883 - DNA, 71 bp, chicken (Gallus Gallus)
  misc_feature (36): n=c or t
gagctgctgacggtggtggggctcaggaggagctcngctgatgcaaagtgaatttcagacacgaaatcatt

SEQ ID NO: 39884 - DNA, 71 bp, chicken (Gallus Gallus)
  misc_feature (36): n=c or t
catacagccacagcttgtgaaatctgtcacctgctngttaattaatgttctgtggtcactggtatgcacaa

SEQ ID NO: 39885 - DNA, 71 bp, chicken (Gallus Gallus)
  misc_feature (36): n=a or g
ctgtgcctggcatcactttcagtgtgaaacagcccngtttggttagcaacacgtgctttttttttccttaa

SEQ ID NO: 39886 - DNA, 71 bp, chicken (Gallus Gallus)
  misc_feature (36): n=a or c
ctgtgaataaatcatcccactaaagaccaattatancagattctttgattgatgaatggaaaaatatatat

SEQ ID NO: 39887 - DNA, 71 bp, chicken (Gallus Gallus)
  misc_feature (36): n=c or t
aggctcaaaagctacttcaaatttgggatgcaagtntcataggtaagctaaatatttcatgacagactgca

SEQ ID NO: 39888 - DNA, 71 bp, chicken (Gallus Gallus)
  misc_feature (36): n=g or t
ctgtacaggagacgattatagcactaattatcctgnggagatttcaaaatatctttaaaggagcctggaat

SEQ ID NO: 39889 - DNA, 71 bp, chicken (Gallus Gallus)
  misc_feature (36): n=a or g
atccctgccccatggacatccagggtgacggctggntgtgctgtgtgacaaaccaggagacagggagggca

SEQ ID NO: 39890 - DNA, 71 bp, chicken (Gallus Gallus)
  misc_feature (36): n=c or t
ctgggcagtgctgctcacagtggaacccaacggggncggggctgagctctgcctgacctcagcacctctgt

SEQ ID NO: 39891 - DNA, 71 bp, chicken (Gallus Gallus)
  misc_feature (36): n=a or g
caaagtgctcagagatgcttcagcagcactgactcnatgtgatacgggatgggatgagcatattccacacc

SEQ ID NO: 39892 - DNA, 71 bp, chicken (Gallus Gallus)
  misc_feature (36): n=g or t
tgtgtgtactacctctcctacaagcacacacaggangtccctagagcttccccctggcagctgtaggaaga

SEQ ID NO: 39893 - DNA, 71 bp, chicken (Gallus Gallus)
  misc_feature (36): n=c or t
tctcatggcttttgcctgtatctgccagcacgcagngtgatcagtgtttttttcccctctgttcttgagca

SEQ ID NO: 39894 - DNA, 71 bp, chicken (Gallus Gallus)
  misc_feature (36): n=a or g
tagcacaagaggaagggcttacaattaaagctcaanctgtactctgactcaaaggggaattgttgcagttt

SEQ ID NO: 39895 - DNA, 71 bp, chicken (Gallus Gallus)
  misc_feature (36): n=a or g
gatgagaaggcgatgtgacagagctcagagcactgngagtaattggaggcccacggacaaagttgctcacg

SEQ ID NO: 39896 - DNA, 71 bp, chicken (Gallus Gallus)
  misc_feature (36): n=a or g
caggtctcagcacagcttgtatctctctttaacctntgtgactgctagggaagtgtgttttctgtctgttc

SEQ ID NO: 39897 - DNA, 71 bp, chicken (Gallus Gallus)
  misc_feature (36): n=c or t
aacacagctcctaactttcaaaggttctgctaacanttttgtatttcagagaatataagattatgatttac

SEQ ID NO: 39898 - DNA, 71 bp, chicken (Gallus Gallus)
  misc_feature (36): n=c or t
tttttgtccaggaattaaaaagatcatctctgggangaagaatcaggaatgtgcttattttgacaagtaat

SEQ ID NO: 39899 - DNA, 71 bp, chicken (Gallus Gallus)
  misc_feature (36): n=a or g
tggcatcagctcagcccgttccatccccaggacccngagcagttctgtttgaccccggctcgcatcgagcc

SEQ ID NO: 39900 - DNA, 71 bp, chicken (Gallus Gallus)
  misc_feature (36): n=c or t
gtttcagagctcactctccgagctgagcttcagctntccaaagagctggaaaataggactttatctctttt

SEQ ID NO: 39901 - DNA, 71 bp, chicken (Gallus Gallus)
  misc_feature (36): n=c or t
accaagggaagaaaccaatctgcccaattctgtaanggcttcgctatttctttgcattggaagcacatttt

SEQ ID NO: 39902 - DNA, 71 bp, chicken (Gallus Gallus)
  misc_feature (36): n=a or g
cccaaactcactcatctccaaacagaaagggaaggnaaactgaggcacaccaccctgcaagcctacagcca

SEQ ID NO: 39903 - DNA, 71 bp, chicken (Gallus Gallus)
  misc_feature (36): n=c or t
gagcgacctgctgtcctgttgcatggccaacgttgnacatcccagcagttccacttccattctgcagagac

SEQ ID NO: 39904 - DNA, 71 bp, chicken (Gallus Gallus)
  misc_feature (36): n=a or g
caatgggttttgataataaggcagtttgcatgggcnaatgtcactgctcagctgtacttttcagtggggga

SEQ ID NO: 39905 - DNA, 71 bp, chicken (Gallus Gallus)
  misc_feature (36): n=c or t
ggtcactccataggaggaagcttccaaaggaaagcnggtgtgccgtcactgcagggatcgcttattctatg

SEQ ID NO: 39906 - DNA, 71 bp, chicken (Gallus Gallus)
  misc_feature (36): n=c or t
tatggcaacaggagttttagcactctgcttcaagcnttagattcacaagcataccactaagcatcacattt

SEQ ID NO: 39907 - DNA, 71 bp, chicken (Gallus Gallus)
  misc_feature (36): n=a or g
tcaaattgcagcacagcatcccatggcagtgctctntgggtcccgttcccagaggaaagatttggtgcatc

SEQ ID NO: 39908 - DNA, 71 bp, chicken (Gallus Gallus)
  misc_feature (36): n=c or t
ccttctacaccttgcatttctatctcatttatgctntaagtctccagtattccttctcaaccagaacaaaa

SEQ ID NO: 39909 - DNA, 71 bp, chicken (Gallus Gallus)
  misc_feature (36): n=c or t
agaactgaggacaaacttgaggtcttctcctcctgntactgcagcacataagtgccatcctgtcgctgctg

SEQ ID NO: 39910 - DNA, 71 bp, chicken (Gallus Gallus)
  misc_feature (36): n=a or g
cttccttcaatccgaaggagattctctgagtgggcngatggataatgggttgcagtttatatctctgccaa

SEQ ID NO: 39911 - DNA, 71 bp, chicken (Gallus Gallus)
  misc_feature (36): n=a or c
ggggaagatgcatcccttgcctccataggagctgcntgatggtaccagaaataaatatgcttaggccaata

SEQ ID NO: 39912 - DNA, 71 bp, chicken (Gallus Gallus)
  misc_feature (36): n=a or g
ttttttttcctctcatatgcaagagctgcccagacnaagccgagggctcacaaagggcgtttggcagattg

SEQ ID NO: 39913 - DNA, 71 bp, chicken (Gallus Gallus)
  misc_feature (36): n=a or g
gtggcagcagcgtgatgcagtgctcgctgcctgccnttgcagacccagcaatgtgtgccctacctgaggag

SEQ ID NO: 39914 - DNA, 71 bp, chicken (Gallus Gallus)
  misc_feature (36): n=a or c
atagcagacagctacagcagtgtcccctggttgtantgaaaggaaaaacggctctccagccatactgctgt

SEQ ID NO: 39915 - DNA, 71 bp, chicken (Gallus Gallus)
  misc_feature (36): n=a or c
ttggtcatctttgtattgcatgggattcttttggcnatggactgatcaaaatcttgctgctgccctcgtgt

SEQ ID NO: 39916 - DNA, 71 bp, chicken (Gallus Gallus)
  misc_feature (36): n=c or t
tatccattgctctgaccgaggccgttcactgcacgntctttttcatgctctgagttcccatttgctttgtg

SEQ ID NO: 39917 - DNA, 71 bp, chicken (Gallus Gallus)
  misc_feature (36): n=a or c
gctacataatcccctcgaagtttgctcagaaacccncataaacagcattaggggcacagtgctcctcagct

SEQ ID NO: 39918 - DNA, 71 bp, chicken (Gallus Gallus)
  misc_feature (36): n=c or t
ctaaggctgatctcaaaaatccaatttattactatntcatgctaacctttatccagaatcagcatttatca

SEQ ID NO: 39919 - DNA, 71 bp, chicken (Gallus Gallus)
  misc_feature (36): n=c or t
tggaccaattaagagatgtaccttgcatgaagcaangtatttaaccaaaactaagaaagccatgtgctaat

SEQ ID NO: 39920 - DNA, 71 bp, chicken (Gallus Gallus)
  misc_feature (36): n=a or g
aaaacaagaaagcaaaacaccagcacacacggccantaggactacctgcaaggttaggtgcaatttctggc

SEQ ID NO: 39921 - DNA, 71 bp, chicken (Gallus Gallus)
  misc_feature (36): n=a or g
caaatgagtgcaccaggagagggagaaacaaaacantagctccaaaaccaaacattttcacatggatcaaa

SEQ ID NO: 39922 - DNA, 71 bp, chicken (Gallus Gallus)
  misc_feature (36): n=a or g
agcagggctctggcagaaagagagccagcgcgtaantaagaggcagaatgacacgactgggaacagtgtgc

SEQ ID NO: 39923 - DNA, 71 bp, chicken (Gallus Gallus)
  misc_feature (36): n=c or t
gtcaggcattatacccttatcagtgcttcaagctgnatcccagggctgcagaaggccccagaatagctcct

SEQ ID NO: 39924 - DNA, 71 bp, chicken (Gallus Gallus)
  misc_feature (36): n=a or g
atgctacagtacgggttgatgcctgtcccgctctgnttggcctcctgctctccaagcctcaggatgttctc

SEQ ID NO: 39925 - DNA, 71 bp, chicken (Gallus Gallus)
  misc_feature (36): n=c or t
gaatataatggaatctagggttattataggtgaccnagggaagactcaatgctgtacctgtatttgtgctc

SEQ ID NO: 39926 - DNA, 71 bp, chicken (Gallus Gallus)
  misc_feature (36): n=a or g
ggttctggagctcggtgctggtgaccctctaaacgntctcatttgggaccttattgaatggcagacaaatt

SEQ ID NO: 39927 - DNA, 71 bp, chicken (Gallus Gallus)
  misc_feature (36): n=c or t
ttcagtcttgctcaatttataacaggggaaaaacgnacctttattttctgggaaaacattcctcaaaaaag

SEQ ID NO: 39928 - DNA, 71 bp, chicken (Gallus Gallus)
  misc_feature (36): n=a or g
gcaaaaggctcggttctggcccagcttggcatagcngtgttcaacaccgatggttcccctcgtttagttta

SEQ ID NO: 39929 - DNA, 71 bp, chicken (Gallus Gallus)
  misc_feature (36): n=g or t
gtgagttctgacagacaaccataactgagcgtaggngtgaagaggtccttttagtgctggagtcagtgctg

SEQ ID NO: 39930 - DNA, 71 bp, chicken (Gallus Gallus)
  misc_feature (36): n=a or g
gctggggagatggatttggagatggggttttgaagnatgctgtcctgcattggataacgggaatgctttca

SEQ ID NO: 39931 - DNA, 71 bp, chicken (Gallus Gallus)
  misc_feature (36): n=a or g
tgccctggggcatcccgaggaggtggggcagaactnctacaacagcccaccctctgctcccacgcttggtg

SEQ ID NO: 39932 - DNA, 71 bp, chicken (Gallus Gallus)
  misc_feature (36): n=c or t
caaagaatggaaatacacaaaaccagagcaggcatngggtgaaaactccttccacttttataattacagaa

SEQ ID NO: 39933 - DNA, 71 bp, chicken (Gallus Gallus)
  misc_feature (36): n=c or t
agagtgcgacagagcccagggtgcagtcagccctgngggtcctgagaccagaacggggctggggacggctt

SEQ ID NO: 39934 - DNA, 71 bp, chicken (Gallus Gallus)
  misc_feature (36): n=a or g
ctggttttaagagagtctctgaatattaaaactgcnggaagctgaagatgccaagaaacacctacaagtat

SEQ ID NO: 39935 - DNA, 71 bp, chicken (Gallus Gallus)
  misc_feature (36): n=c or t
tccaccttctcaagggagtctttgctccagggcttnctgctctgagcagctgaactcaggttcagtcttcc

SEQ ID NO: 39936 - DNA, 71 bp, chicken (Gallus Gallus)
  misc_feature (36): n=a or g
gttttcagcctctccagtgctgtatgtttgttacantcccaggtgctttaatgttactgtgtagcatttca

SEQ ID NO: 39937 - DNA, 71 bp, chicken (Gallus Gallus)
  misc_feature (36): n=c or t
gttgcattgcattgatgtacataccttgcaggtaangagcacttcacagttctcagtaaccttccatttca

SEQ ID NO: 39938 - DNA, 71 bp, chicken (Gallus Gallus)
  misc_feature (36): n=g or t
ccttgctggggtcatacattataactggatcactgntttttgaaggatgactgatccctgctttattgaca

SEQ ID NO: 39939 - DNA, 71 bp, chicken (Gallus Gallus)
  misc_feature (36): n=a or c
taaaataaaataaaatacaagcaacaaattcacggncaaaaacaagagaaatggagccaaaagagcaagat

SEQ ID NO: 39940 - DNA, 71 bp, chicken (Gallus Gallus)
  misc_feature (36): n=a or g
ttactaatggcaaaggctcagctcaaacacaatacnatgacgccaagctgggtcagattccagagcagctc

SEQ ID NO: 39941 - DNA, 71 bp, chicken (Gallus Gallus)
  misc_feature (36): n=a or g
ttataatgtgttccactgtcagagttagaggctggnatgatgagagccctctgaagtcctgttgaagtaga

SEQ ID NO: 39942 - DNA, 71 bp, chicken (Gallus Gallus)
  misc_feature (36): n=c or t
tttattagggggctgatcagattgcatccagccctntgattaatctcctgcaggtcgccgtgctgcactgc

SEQ ID NO: 39943 - DNA, 71 bp, chicken (Gallus Gallus)
  misc_feature (36): n=a or c
tcctgagtgctgcattagtagatgtgtacctgaaancgcacatgcgaaatgatgcgtacgcactgccacat

SEQ ID NO: 39944 - DNA, 71 bp, chicken (Gallus Gallus)
  misc_feature (36): n=c or t
tggagggaagacacagcacggggacatggctctcangcaggttttcccttgcctgagttttgaaagagaag

SEQ ID NO: 39945 - DNA, 71 bp, chicken (Gallus Gallus)
  misc_feature (36): n=a or c
gagctgacagacctgatctgaggctatgggttcctncatgggtgttgtaccacgtccatgagggaacctcc

SEQ ID NO: 39946 - DNA, 71 bp, chicken (Gallus Gallus)
  misc_feature (36): n=a or c
ccctcctctcagaacacttttgcaacaacgttatcntgcaaattaaattgcatcctgcagcgatttcaaag

SEQ ID NO: 39947 - DNA, 71 bp, chicken (Gallus Gallus)
  misc_feature (36): n=a or g
ggctaatcagggagttaaggtgacatttagagattnaagctagctcagatggctctcactcccagggagat

SEQ ID NO: 39948 - DNA, 71 bp, chicken (Gallus Gallus)
  misc_feature (36): n=a or g
tctgtgagtcacatcaggacagcagcgagggttacngatgcagagctgtttgcagatctagcagggcactt

SEQ ID NO: 39949 - DNA, 71 bp, chicken (Gallus Gallus)
  misc_feature (36): n=a or g
cctgaaatgcttattttcccagttaacttttatgcntgagcaaatacatgggaacatatatgagacgccac

SEQ ID NO: 39950 - DNA, 71 bp, chicken (Gallus Gallus)
  misc_feature (36): n=a or g
gacagaaatccattaatatcttataaagcattcacnctctatagcagtgagtgccacagaaaacactccga

SEQ ID NO: 39951 - DNA, 71 bp, chicken (Gallus Gallus)
  misc_feature (36): n=a or g
gagaatttgtgaagttttgtgtggtctgtatgaacntggagagctgaaggatggaaaatccacgctgactt

SEQ ID NO: 39952 - DNA, 71 bp, chicken (Gallus Gallus)
  misc_feature (36): n=c or t
ttgaggagtaaaattatccaggagcagagatgaaangtgaatgttagaagttgccttccattgtctgtgct

SEQ ID NO: 39953 - DNA, 71 bp, chicken (Gallus Gallus)
  misc_feature (36): n=c or t
ttgggtgcacagcattccccatggggttttcccagnccattattctgttcactgtgacgtttaacctcctt

SEQ ID NO: 39954 - DNA, 71 bp, chicken (Gallus Gallus)
  misc_feature (36): n=a or g
tccttctgcagaagagcagacaaggagggatgacgntgttgggtgtttttgttccagacctcatatctctc

SEQ ID NO: 39955 - DNA, 71 bp, chicken (Gallus Gallus)
  misc_feature (36): n=c or t
acagaaacagcatcgtccttagcccaagaaactgcntccagcagccagaaagtcggtgaaggccagcaggg

SEQ ID NO: 39956 - DNA, 71 bp, chicken (Gallus Gallus)
  misc_feature (36): n=c or t
atgatgtacattaggaaactatgtgaagcaccggtnggagaaaaaggaaaaggtaaattggtagggtgcta

SEQ ID NO: 39957 - DNA, 71 bp, chicken (Gallus Gallus)
  misc_feature (36): n=a or g
aggctcatttctcacctggaggggaaaagatgtggnacaaaatcagacaaggttttagaacaagatgggaa

SEQ ID NO: 39958 - DNA, 71 bp, chicken (Gallus Gallus)
  misc_feature (36): n=a or g
aggctgaagttttagctcagctaactccaacagaanaaaggaataggatgggactgatctgcgaatatggg

SEQ ID NO: 39959 - DNA, 71 bp, chicken (Gallus Gallus)
  misc_feature (36): n=c or t
tctcactttcacaaatgcacagaaaccctatttgcncctctgtagggtggctgtctggttagcacagtcag

SEQ ID NO: 39960 - DNA, 71 bp, chicken (Gallus Gallus)
  misc_feature (36): n=c or t
ggtctgagatagaaaagtgctgatattcgtagatgnagagcacagacatgactctttctaagtgggttaat

SEQ ID NO: 39961 - DNA, 71 bp, chicken (Gallus Gallus)
  misc_feature (36): n=c or t
gcatgttggagtctacataactcacatgcttaattngcaagctgaagtgctgtagagggtttgaaccaggt

SEQ ID NO: 39962 - DNA, 71 bp, chicken (Gallus Gallus)
  misc_feature (36): n=g or t
cctgcatgaaattattctcttggaaaggccattttnggggtccaaaagattgtcatgtgaaaaatactgac

SEQ ID NO: 39963 - DNA, 71 bp, chicken (Gallus Gallus)
  misc_feature (36): n=c or t
cacaagcagttctgttttagaacagatgatgtctanagggggaccagacctacatgtatagcctattagct

SEQ ID NO: 39964 - DNA, 71 bp, chicken (Gallus Gallus)
  misc_feature (36): n=a or g
aatggtatctttggggactttggtcaaaagaaagcngttctctcagtgtttctatgtgtgatgtgtcactg

SEQ ID NO: 39965 - DNA, 71 bp, chicken (Gallus Gallus)
  misc_feature (36): n=c or t
tctcatgttggacaggagaatcaccaaagacattcntggaaatttagggtatcatgttcatctggttgtgt

SEQ ID NO: 39966 - DNA, 71 bp, chicken (Gallus Gallus)
  misc_feature (36): n=c or t
atctccgtgctcagaaagatacattaatggaaaaangttatgcaaggaaaatgccataatatggttttagg

SEQ ID NO: 39967 - DNA, 71 bp, chicken (Gallus Gallus)
  misc_feature (36): n=c or t
atttatttcataggtgatgtgtaactttaaagacantgagtatggtttcacagcacaaaatggaaacagat

SEQ ID NO: 39968 - DNA, 71 bp, chicken (Gallus Gallus)
  misc_feature (36): n=c or t
tcccaatgtaaagttagcctatatccagccctgtancagcatgcttcatcaaggcagtgttaatgtttgca

SEQ ID NO: 39969 - DNA, 71 bp, chicken (Gallus Gallus)
  misc_feature (36): n=c or t
cctagggaataacagccccgctgcaagccagaatcnaacatccacagcacagaaggcagagtgcaagttgt

SEQ ID NO: 39970 - DNA, 71 bp, chicken (Gallus Gallus)
  misc_feature (36): n=a or g
atttaaaaaagttatgtagctacctgggagcttggnatgatctggaatttcacctagagttcctggagtag

SEQ ID NO: 39971 - DNA, 71 bp, chicken (Gallus Gallus)
  misc_feature (36): n=c or t
acctttgtatttggtacatacaaggaaccatacttncaagttgcatagcatgacatttatgtgggggttgg

SEQ ID NO: 39972 - DNA, 71 bp, chicken (Gallus Gallus)
  misc_feature (36): n=c or t
tcaaactctgtgtgctcacagccaggtttgtctgcntgctcctgaagctcccagcgtgggtaagagccggg

SEQ ID NO: 39973 - DNA, 71 bp, chicken (Gallus Gallus)
  misc_feature (36): n=c or t
agcatgagataatcctggggcagaaaggaaatgtcngtgggtttggtgttttgttaaagtgcttttgttgt

SEQ ID NO: 39974 - DNA, 71 bp, chicken (Gallus Gallus)
  misc_feature (36): n=c or t
gacacgctgaccgtcaggaggtaaaacacttctttnggtgttcaaatgtgttattttcagaactgcttgct

SEQ ID NO: 39975 - DNA, 71 bp, chicken (Gallus Gallus)
  misc_feature (36): n=c or t
aggagatgaacactgcaactaccatacaaaacagangaaacacattcagcagcggagaccattcagagagg

SEQ ID NO: 39976 - DNA, 71 bp, chicken (Gallus Gallus)
  misc_feature (36): n=a or g
aattacaaaatggctgtacaaatagcttgacatcanatcctgcattgggtgaagaacgtgcaaacaaggat

SEQ ID NO: 39977 - DNA, 71 bp, chicken (Gallus Gallus)
  misc_feature (36): n=a or c
tatttttggaaataggtgtactgagatcccaaaaancacatggaatgtgtgcatgaaaacagcactgtgcc

SEQ ID NO: 39978 - DNA, 71 bp, chicken (Gallus Gallus)
  misc_feature (36): n=c or t
tatcccccaaataataggggtaacaaggagcacatnagagcctctccattttcctatttcccattagctca

SEQ ID NO: 39979 - DNA, 71 bp, chicken (Gallus Gallus)
  misc_feature (36): n=a or c
aattgtgaaacattacatttgcagcctggtggcatntttcaggttgcgagataaaatcctgtgtctacact

SEQ ID NO: 39980 - DNA, 71 bp, chicken (Gallus Gallus)
  misc_feature (36): n=a or g
aatcgtgcatggactgagttggagtaaagacttccnagcaagttctcctcctgggacacatgggtgtgatt

SEQ ID NO: 39981 - DNA, 71 bp, chicken (Gallus Gallus)
  misc_feature (36): n=a or g
ttgctcaggaattaaagcaagagttgcagtaattgnggatggttttatcatcgggggaaacgtccccgagc

SEQ ID NO: 39982 - DNA, 71 bp, chicken (Gallus Gallus)
  misc_feature (36): n=a or g
ggctgtctgcattgccacctctctctgatgaccacnacagccctgaggctgagcagtggagtgaacccagg

SEQ ID NO: 39983 - DNA, 71 bp, chicken (Gallus Gallus)
  misc_feature (36): n=c or t
aactggagttattacatccccagaaacaaaaaaccnatggaaatatcctgatttgaaagctctgtcaagag

SEQ ID NO: 39984 - DNA, 71 bp, chicken (Gallus Gallus)
  misc_feature (36): n=c or t
gggggtgtgggtctgcctcaacagagccatcccagngcgccttaccagcccaccacggggatcaatgctca

SEQ ID NO: 39985 - DNA, 71 bp, chicken (Gallus Gallus)
  misc_feature (36): n=a or g
ttgacttgtaagagggtcaggttggtttgggcagcnatttgcctcttctcatcctctgtgggataggggtg

SEQ ID NO: 39986 - DNA, 71 bp, chicken (Gallus Gallus)
  misc_feature (36): n=a or g
ttctgttttactatgcaacagcacggatgtaaaatnagccaaatatttctggagaacaaatctgttgaaag

SEQ ID NO: 39987 - DNA, 71 bp, chicken (Gallus Gallus)
  misc_feature (36): n=c or t
agcagttgaatttaactgtttagcataaatatcaancacagctcagtttagcaccaacacgatggatcagt

SEQ ID NO: 39988 - DNA, 71 bp, chicken (Gallus Gallus)
  misc_feature (36): n=a or g
acagtggatttcgaatagccctcgtgttgcaatggntgttattaacaaaaagatgtctaacccaaggtaga

SEQ ID NO: 39989 - DNA, 71 bp, chicken (Gallus Gallus)
  misc_feature (36): n=c or t
gcagccactgctatgcgttttccttcactctgcaangctttcaaatgtcctctttattacaaataaatcta

SEQ ID NO: 39990 - DNA, 71 bp, chicken (Gallus Gallus)
  misc_feature (36): n=c or t
tgagattatcaatgaaacatattggaacagagcagngtagataccttttgtttatagctcacaatgaaata

SEQ ID NO: 39991 - DNA, 71 bp, chicken (Gallus Gallus)
  misc_feature (36): n=c or t
cgtttgaaattaaaatgatgcaatcccaatcattantcttcaggtgtacaagagtgccagcaaacgcaaag

SEQ ID NO: 39992 - DNA, 71 bp, chicken (Gallus Gallus)
  misc_feature (36): n=a or c
agacttgcctgctttgctagatctggtctatgtacngaactcatgttatgtctagggaccaggagagagga

SEQ ID NO: 39993 - DNA, 71 bp, chicken (Gallus Gallus)
  misc_feature (36): n=g or t
ttcaaagatgctgcatcagacacagaatcttgattntgattgaagagtttcttgatttgaggcatatatat

SEQ ID NO: 39994 - DNA, 71 bp, chicken (Gallus Gallus)
  misc_feature (36): n=a or g
acatggactcgcatttccacacttaataatatgctntgcatctatgtggatccttctgggttcacatggac

SEQ ID NO: 39995 - DNA, 71 bp, chicken (Gallus Gallus)
  misc_feature (36): n=c or t
tgagtggacagacagtgcccttcagagagaagcatnatacctaatgcagcattgcccctcagagcagcagc

SEQ ID NO: 39996 - DNA, 71 bp, chicken (Gallus Gallus)
  misc_feature (36): n=c or t
cacaacagtgagtgttgtgaaagagaaagtggcttntctcgtccccggacggattgcccgcccgtctcact

SEQ ID NO: 39997 - DNA, 71 bp, chicken (Gallus Gallus)
  misc_feature (36): n=c or t
cacccaccttcaccaagaagatggcatcactcgggncctctgcattttgctgttggagttcttatccacaa

SEQ ID NO: 39998 - DNA, 71 bp, chicken (Gallus Gallus)
  misc_feature (36): n=c or t
ttgctctgttatcacttacaggctctgttttggaangaggcttaaatagaaataacatggtattaaaggtt

SEQ ID NO: 39999 - DNA, 71 bp, chicken (Gallus Gallus)
  misc_feature (36): n=c or t
ctggtggcactgcagtgacccggggctgagggatcncggggctctctgccctgcaagaatgcatccctggc

SEQ ID NO: 40000 - DNA, 71 bp, chicken (Gallus Gallus)
  misc_feature (36): n=a or g
ctctgcccctcagaacaaaggcaaaagatgcactgngtgatgctaaggaacaagcaggcagcgacaaaagg

SEQ ID NO: 40001 - DNA, 71 bp, chicken (Gallus Gallus)
  misc_feature (36): n=a or g
ctcaggtacatccgcctatgggctttttttacccangacactgtcagagatctgcaaatagcaaacactgg

SEQ ID NO: 40002 - DNA, 71 bp, chicken (Gallus Gallus)
  misc_feature (36): n=c or t
catgagtattttagctttttttcgttcctcgcggantctgctgctaacaattcccagtttctgggacaaac

SEQ ID NO: 40003 - DNA, 71 bp, chicken (Gallus Gallus)
  misc_feature (36): n=c or t
cccatgaaggtttttaactatccagaatttcttcanatccacatcataggaactcagagttcctctaagca

SEQ ID NO: 40004 - DNA, 71 bp, chicken (Gallus Gallus)
  misc_feature (36): n=c or t
attgctgagagctctgttatgtcattccaccaaccncttggccaaaaaactgcctttacggaaaagatcca

SEQ ID NO: 40005 - DNA, 71 bp, chicken (Gallus Gallus)
  misc_feature (36): n=a or g
gccagatatggacaagatgagccaccagccccccantttgatgttaagagatacaagctcagctcttggct

SEQ ID NO: 40006 - DNA, 71 bp, chicken (Gallus Gallus)
  misc_feature (36): n=a or g
caccaaaggtaacagggcagaactgcaggtagccangactgcagcacgccatgctcctcagcagcaaggaa

SEQ ID NO: 40007 - DNA, 71 bp, chicken (Gallus Gallus)
  misc_feature (36): n=a or g
gcggtgcctgtaagaaatggaggaatccattgtttngtcttgagagctcattccgaagtgacacagaggct

SEQ ID NO: 40008 - DNA, 71 bp, chicken (Gallus Gallus)
  misc_feature (36): n=a or c
tgccatgcagcccagtgttgaggtgtatttattagnatcattactgtggtattgctatctgcaagcaggag

SEQ ID NO: 40009 - DNA, 71 bp, chicken (Gallus Gallus)
  misc_feature (36): n=c or t
aatctggctgccttgattcccgttgaagcatcgagntgctccgctacgttataaggcacaaaacctgcagc

SEQ ID NO: 40010 - DNA, 71 bp, chicken (Gallus Gallus)
  misc_feature (36): n=c or t
tgggtgaggtctgatagagggaaaatgctttttgtnctctttcttctgctacatctggggcatttgcatgg

SEQ ID NO: 40011 - DNA, 71 bp, chicken (Gallus Gallus)
  misc_feature (36): n=c or t
caaatgcatttccagacctttagatatacttgcaangtcttcaatatgttttccttaccttcctgccatca

SEQ ID NO: 40012 - DNA, 71 bp, chicken (Gallus Gallus)
  misc_feature (36): n=a or g
tttgattgctgatctgccttattatgtttttaaatncactttaatattttagttttagcgactctctgtct

SEQ ID NO: 40013 - DNA, 71 bp, chicken (Gallus Gallus)
  misc_feature (36): n=g or t
aacagacagaggtgttttcatggtgggctttgctgnatacatctgttggtcatagttcttgcatctcaaca

SEQ ID NO: 40014 - DNA, 71 bp, chicken (Gallus Gallus)
  misc_feature (36): n=c or t
ggcacttgcaggatgaggagcaaagctcttaatgcntcccgttccctccctgggctgcaaatctcacgtgg

SEQ ID NO: 40015 - DNA, 71 bp, chicken (Gallus Gallus)
  misc_feature (36): n=c or t
atgctaacccccactttatacattttatatatagcncacatgcactgaatttacctgaggattaaaaggga

SEQ ID NO: 40016 - DNA, 71 bp, chicken (Gallus Gallus)
  misc_feature (36): n=c or t
acagcaaggagggccccctccaagcaaatgttgccngttctaaatgggcagcactgacctgttccagtctg

SEQ ID NO: 40017 - DNA, 71 bp, chicken (Gallus Gallus)
  misc_feature (36): n=c or t
atggggtttttaagcatgcacatggctgggagggcnctctggaggagaagagccccgaatgtccccatgtg

SEQ ID NO: 40018 - DNA, 71 bp, chicken (Gallus Gallus)
  misc_feature (36): n=a or c
cacttctctgctgccagctgatccttaaaacccaanccagagcaaaaagaggttctactgagcagtgtatg

SEQ ID NO: 40019 - DNA, 71 bp, chicken (Gallus Gallus)
  misc_feature (36): n=c or t
ataaactgtcacaggatgttttgttttcaagccctnagcgttcccagttgcactcagtttatttcatgagg

SEQ ID NO: 40020 - DNA, 71 bp, chicken (Gallus Gallus)
  misc_feature (36): n=a or g
ttctccatagtgcacaccaaggctggagctttgggnctgggctctggggaggccgaggctattttcttacc

SEQ ID NO: 40021 - DNA, 71 bp, chicken (Gallus Gallus)
  misc_feature (36): n=a or c
ctttctgtgtcgtggtgcttctgctggtgatgtganctggctgcaggagcatgcagtgggtttgctgcagg

SEQ ID NO: 40022 - DNA, 71 bp, chicken (Gallus Gallus)
  misc_feature (36): n=a or g
tctcagagagggcaggagggacgaaagtagatgaangaggccaaagggacacaaacagaggagaagatata

SEQ ID NO: 40023 - DNA, 71 bp, chicken (Gallus Gallus)
  misc_feature (36): n=c or t
tctcctggaggcaccatatccatctccagaagaatngctccgttacgagtccggaagggacaaaagaaaat

SEQ ID NO: 40024 - DNA, 71 bp, chicken (Gallus Gallus)
  misc_feature (36): n=a or g
ggtggattgcaaatccaatgtgcaatgggaaacaangggtgcaactgatggacaagtgacatgccctgagc

SEQ ID NO: 40025 - DNA, 71 bp, chicken (Gallus Gallus)
  misc_feature (36): n=a or g
ctccagctcgcagtctgggtacctggtgagcacacnctgtccccttggctctcacaaagggccaagcacgg

SEQ ID NO: 40026 - DNA, 71 bp, chicken (Gallus Gallus)
  misc_feature (36): n=a or g
cttccctctgtagttttctccccacgaggcaattanacagataacaaacggcttcaaggcacctcggagac

SEQ ID NO: 40027 - DNA, 71 bp, chicken (Gallus Gallus)
  misc_feature (36): n=c or t
agttgaaaggtttgcttctggaatcatcagttccanggcgctgagactcagaagcagggacttttctcttt

SEQ ID NO: 40028 - DNA, 71 bp, chicken (Gallus Gallus)
  misc_feature (36): n=a or g
tgaaaagcttcactgcacaacccacaaagccgagangactgcaggcactgcactgcatgacagcagtctgt

SEQ ID NO: 40029 - DNA, 71 bp, chicken (Gallus Gallus)
  misc_feature (36): n=a or c
aacgagctgcactgctcggaaagtcagactgctttntttgcctccccctcaaagcctgaaaatgaaggctg

SEQ ID NO: 40030 - DNA, 71 bp, chicken (Gallus Gallus)
  misc_feature (36): n=c or t
ctcactgcactaatgccttcagagctgtgtctctcngaatgaggcaaaggtgcaccacagatctatcaatc

SEQ ID NO: 40031 - DNA, 71 bp, chicken (Gallus Gallus)
  misc_feature (36): n=a or g
attgccatcaccatttaattccacctcggctgcacncatacattttttagaagttactgctgtgctgcact

SEQ ID NO: 40032 - DNA, 71 bp, chicken (Gallus Gallus)
  misc_feature (36): n=a or g
gcagcagtggggcggagcccctcccgagcagcccangggcgcagcactcacgaaggcacggctctgctcgc

SEQ ID NO: 40033 - DNA, 71 bp, chicken (Gallus Gallus)
  misc_feature (36): n=a or g
catctctctgcttgctgcaaagtctctctgctttcnatgtgacctggtgcagtaactcaggagacacggaa

SEQ ID NO: 40034 - DNA, 71 bp, chicken (Gallus Gallus)
  misc_feature (36): n=c or t
gccccacagcaaccctgtacctggcatggccacacnggagccctctgccctcccaggtcaaagcatcagcc

SEQ ID NO: 40035 - DNA, 71 bp, chicken (Gallus Gallus)
  misc_feature (36): n=a or g
ttgagcggagccgcacgcaccccggaggaaacggcnacctcctgtcctcacctgcataccccgggtcgaca

SEQ ID NO: 40036 - DNA, 71 bp, chicken (Gallus Gallus)
  misc_feature (36): n=a or g
tagggagaaggagctgagggtagagatgctgccccngtggtgaactttggttccttactgacgtgtttatt

SEQ ID NO: 40037 - DNA, 71 bp, chicken (Gallus Gallus)
  misc_feature (36): n=a or g
tgaaaaaaagtcctcttaaggagtcctcttaattcntttggaagcagctagctcctttgaagagcctgcaa

SEQ ID NO: 40038 - DNA, 71 bp, chicken (Gallus Gallus)
  misc_feature (36): n=a or g
ttgttttttttagggcctattgactttctacgagcnaacaccactgagaaacagggatttagaacagggag

SEQ ID NO: 40039 - DNA, 71 bp, chicken (Gallus Gallus)
  misc_feature (36): n=a or g
attaccacttttccttttgctaaggagagcaaaacnaaagctagggcagcaattgccttctttaaccatcc

SEQ ID NO: 40040 - DNA, 71 bp, chicken (Gallus Gallus)
  misc_feature (36): n=c or t
aaaccacggcgcagttcactggcatcaattggtgcngggatgctggcggtacctgcaggacatccccacgc

SEQ ID NO: 40041 - DNA, 71 bp, chicken (Gallus Gallus)
  misc_feature (36): n=a or g
atccacctcacccctctgctcttgtcgtccccagtngcaaacggtgtgagcgcctggtacagagagctgaa

SEQ ID NO: 40042 - DNA, 71 bp, chicken (Gallus Gallus)
  misc_feature (36): n=a or g
gtgcataacgccctctgcaaagaaagggaaggatangctgagagctctcttgtaagtgctggagtgtaggt

SEQ ID NO: 40043 - DNA, 71 bp, chicken (Gallus Gallus)
  misc_feature (36): n=a or g
aaaaagaaatgagcccaggttcctgggttcctaccntgcttctgttgttgacttgtcctcaacaccatgca

SEQ ID NO: 40044 - DNA, 71 bp, chicken (Gallus Gallus)
  misc_feature (36): n=c or t
cttacaagtttagcatcaatccagtgtaattatttnacttagcagaaccagaaaggaattgctacctaaat

SEQ ID NO: 40045 - DNA, 71 bp, chicken (Gallus Gallus)
  misc_feature (36): n=c or t
cccagcccgcctcattaccgctgcctttgggaagcnggagcccatgtgttctcgagatgagcagttggggt

SEQ ID NO: 40046 - DNA, 71 bp, chicken (Gallus Gallus)
  misc_feature (36): n=c or t
ggattgtgggtcatcctctgcctgtataggggaganaactcctgattcgatcccacctcatggagcaatga

SEQ ID NO: 40047 - DNA, 71 bp, chicken (Gallus Gallus)
  misc_feature (36): n=a or g
ttttgggatgcagtgacgggggatgcatccctctgnggacgtgtcacagcaactggcaatgggtgcacctc

SEQ ID NO: 40048 - DNA, 71 bp, chicken (Gallus Gallus)
  misc_feature (36): n=a or g
aggaagagatgagcgttaaaatagaaagtcacctgngggagagaaatacaaagttggactccataaagaga

SEQ ID NO: 40049 - DNA, 71 bp, chicken (Gallus Gallus)
  misc_feature (36): n=c or t
agcattctcttattagatgttaaaacgtaaccaaangtgggactcaagctttagtgctcaaatgcattaag

SEQ ID NO: 40050 - DNA, 71 bp, chicken (Gallus Gallus)
  misc_feature (36): n=c or t
tgttcactagcatctagcaagactcattatgtctgnagtgctggatggcctgacctagcaactcttgctta

SEQ ID NO: 40051 - DNA, 71 bp, chicken (Gallus Gallus)
  misc_feature (36): n=c or t
agcatggttccttgaagctaatcaggcagtttttcntaagttttgtgcagtgccagtttagcagtgggttg

SEQ ID NO: 40052 - DNA, 71 bp, chicken (Gallus Gallus)
  misc_feature (36): n=c or t
agtgactttctgcctgttataacacttgctcagttncataagcagtgtctgtgtctgagacagccccacca

SEQ ID NO: 40053 - DNA, 71 bp, chicken (Gallus Gallus)
  misc_feature (36): n=a or g
tgtttcagagaggaactaactgaaaatctgagatcnaggacactgtcataactcaagtgtatcccttttta

SEQ ID NO: 40054 - DNA, 71 bp, chicken (Gallus Gallus)
  misc_feature (36): n=a or c
tcttactacctggttctggttttgttcgagtccaantggtgttattttcaagggttttattatgaccactg

SEQ ID NO: 40055 - DNA, 71 bp, chicken (Gallus Gallus)
  misc_feature (36): n=c or t
tctaaaataattacgaattggatggacagaagatantctgattgggagtaataactagttgatatttaact

SEQ ID NO: 40056 - DNA, 71 bp, chicken (Gallus Gallus)
  misc_feature (36): n=a or g
tgccttcctggagtttgcagcccatctgcgtctccncattgctgcttttatctggccagaacgtctctact

SEQ ID NO: 40057 - DNA, 71 bp, chicken (Gallus Gallus)
  misc_feature (36): n=c or t
cgagagacccacagaagcagaccacagcaaagcatngtgcagcagggtgcgcatctcagcagctacagcct

SEQ ID NO: 40058 - DNA, 71 bp, chicken (Gallus Gallus)
  misc_feature (36): n=a or c
cgacgctgctgtgcttttatccctgcagggctcacncagagccggcggcgctgcagggacaggggctcctc

SEQ ID NO: 40059 - DNA, 71 bp, chicken (Gallus Gallus)
  misc_feature (36): n=a or c
ctacatggattgatcatctgagaacgaaaccctccntgcactccttggtttgcccttgttctaaaggcaat

SEQ ID NO: 40060 - DNA, 71 bp, chicken (Gallus Gallus)
  misc_feature (36): n=c or t
aatttctaatgataccttccaaaaattactatttgngaactgcgtattggcaagagtgcaccaattcctga

SEQ ID NO: 40061 - DNA, 71 bp, chicken (Gallus Gallus)
  misc_feature (36): n=a or g
ttttctcccttttaatagctgatcctttctggaccnaaattgtctaagtgctcaatacagcacacatttga

SEQ ID NO: 40062 - DNA, 71 bp, chicken (Gallus Gallus)
  misc_feature (36): n=c or t
caggtatcactcatccaccataagacaaaataacantcacagcattcatatatgattctcttttccaattg

SEQ ID NO: 40063 - DNA, 71 bp, chicken (Gallus Gallus)
  misc_feature (36): n=c or t
cttgggtacgctgaacactactgactgtcactggtntaaatggagaagccaaagtccaacccaccatgctc

SEQ ID NO: 40064 - DNA, 71 bp, chicken (Gallus Gallus)
  misc_feature (36): n=a or g
ctgctgtggcagtagggagggtgtcagaagcttaantgacagagctggggggaaatgtgatcgttggggtg

SEQ ID NO: 40065 - DNA, 71 bp, chicken (Gallus Gallus)
  misc_feature (36): n=a or g
aaaattctggatttaggaacagaatcctagagaccntgcataaatatttgggtctgggagctgtgtgtgga

SEQ ID NO: 40066 - DNA, 71 bp, chicken (Gallus Gallus)
  misc_feature (36): n=c or t
ctttgaaataatagccatctgaagattcattccctntggtatgtaacctaaaaggttcactgcagacgaag

SEQ ID NO: 40067 - DNA, 71 bp, chicken (Gallus Gallus)
  misc_feature (36): n=c or t
ctggagactcttgtctgtgttcacctaaatgtgtgnaggtctggagctgttgcaggggggtgcaagctgtg

SEQ ID NO: 40068 - DNA, 71 bp, chicken (Gallus Gallus)
  misc_feature (36): n=a or g
tctgtctgaaggtattgcctgcatcctcagtttgcntgagcaggcaaagctctgttgatgggggtacacag

SEQ ID NO: 40069 - DNA, 71 bp, chicken (Gallus Gallus)
  misc_feature (36): n=a or g
aatatgtttcaggagcttgtcagtggttctgttganctgccttcagcaattccctcaacccatcctattat

SEQ ID NO: 40070 - DNA, 71 bp, chicken (Gallus Gallus)
  misc_feature (36): n=c or t
gtgcacagaaaacatttagccttgaaacaactctcntgcgagaggggaaaaatgaagttccctgagctcaa

SEQ ID NO: 40071 - DNA, 71 bp, chicken (Gallus Gallus)
  misc_feature (36): n=a or g
atggatggacagaaggaaaagaaagcacagcccaantgaaatgagtgtttggaagatgaggatttgagcgt

SEQ ID NO: 40072 - DNA, 71 bp, chicken (Gallus Gallus)
  misc_feature (36): n=c or t
aaaaacccaacgcagcacaaagcaggggcccaacgngtgctgactgccccatatggcggctgtccccgggg

SEQ ID NO: 40073 - DNA, 71 bp, chicken (Gallus Gallus)
  misc_feature (36): n=c or t
caaattgaataatgacactatttaaatgttgtgatnggtagggattgaacccagggccctgctagctgcag

SEQ ID NO: 40074 - DNA, 71 bp, chicken (Gallus Gallus)
  misc_feature (36): n=c or t
cataaccaggactcacttctatgatagctttctggngccttgatcgttcttttggttaacttcaacatcgt

SEQ ID NO: 40075 - DNA, 71 bp, chicken (Gallus Gallus)
  misc_feature (36): n=c or t
agactcctaacaaaaggctcaggtaattgcctgcanctcactggggtgaatggaaggcaaagtgaggtatc

SEQ ID NO: 40076 - DNA, 71 bp, chicken (Gallus Gallus)
  misc_feature (36): n=c or t
ctagtttgggactacatatttctattacacaattgntctggtctttgatatgtgagtgactcagagaggca

SEQ ID NO: 40077 - DNA, 71 bp, chicken (Gallus Gallus)
  misc_feature (36): n=c or t
atgcttgcttggtgaaccttctcaaaagcaggtaangatcctcctatttgattctgttttatcaaacttta

SEQ ID NO: 40078 - DNA, 71 bp, chicken (Gallus Gallus)
  misc_feature (36): n=c or t
gccaccagcaggaagtgctgtaatagacagcggtgntggagatctctccttgcagaagaggaacattcatg

SEQ ID NO: 40079 - DNA, 71 bp, chicken (Gallus Gallus)
  misc_feature (36): n=c or t
aatgctcgcatatgtctttatgaaaaattggagttnggaatgtttatacagccctgaatagtgcaagtgaa

SEQ ID NO: 40080 - DNA, 71 bp, chicken (Gallus Gallus)
  misc_feature (36): n=c or t
ttctcagttcctggatgcttcattcaggtgaaattnggagtccagctcatcgccctttcttggaggtggtt

SEQ ID NO: 40081 - DNA, 71 bp, chicken (Gallus Gallus)
  misc_feature (36): n=a or g
agcaacatgcagcttaattaaatggcatgctcgtgnatttcacattggcttgtgacatgtgcttgcagata

SEQ ID NO: 40082 - DNA, 71 bp, chicken (Gallus Gallus)
  misc_feature (36): n=c or t
gcagcaggtgacaacctgcttgttgtgcagactccnggagcacagtacatgttcctgataagatttatttg

SEQ ID NO: 40083 - DNA, 71 bp, chicken (Gallus Gallus)
  misc_feature (36): n=a or g
ctgcattccttgtgtcagtatgcttcaggttatccngcaggacagactgggccaaagggaagtggccattt

SEQ ID NO: 40084 - DNA, 71 bp, chicken (Gallus Gallus)
  misc_feature (36): n=c or t
tcagcgctactttgtgcccagaagagcccagctctntattttccatcagttagggcccatcaggctctaat

SEQ ID NO: 40085 - DNA, 71 bp, chicken (Gallus Gallus)
  misc_feature (36): n=a or g
ccgtgggcaactgcagtgcatttgattttcctcccnagataaataaaggaccctgggcagagccgtgaaac

SEQ ID NO: 40086 - DNA, 71 bp, chicken (Gallus Gallus)
  misc_feature (36): n=a or g
tggtgcaaggggcaaggctgagtgccctgcacaggngaaggaacatgcgatgcggtgtgccaagagcccca

SEQ ID NO: 40087 - DNA, 71 bp, chicken (Gallus Gallus)
  misc_feature (36): n=a or g
tatcagcacattcaccttttcaacaatcacactgangtagagaaatactgttcacattttagcaacgaggc

SEQ ID NO: 40088 - DNA, 71 bp, chicken (Gallus Gallus)
  misc_feature (36): n=a or g
agctttgcttctaatgggaaaacagctttcactacnaactcatttcaaaacagaggactttacagatgtca

SEQ ID NO: 40089 - DNA, 71 bp, chicken (Gallus Gallus)
  misc_feature (36): n=c or t
tatttaaatgattcctctagcttttccaagaccacnggtaattaaagaacatacagccctcctctgaacgc

SEQ ID NO: 40090 - DNA, 71 bp, chicken (Gallus Gallus)
  misc_feature (36): n=c or t
caatgggtttcgcaaaccagggctgttcacacaccnacaggaccttctgtaagcccctctgctgcacagct

SEQ ID NO: 40091 - DNA, 71 bp, chicken (Gallus Gallus)
  misc_feature (36): n=a or g
ccatgaagtccagcaatactgcagctcatgcagacnttccctaacaagatctcttaattattttcatgaaa

SEQ ID NO: 40092 - DNA, 71 bp, chicken (Gallus Gallus)
  misc_feature (36): n=c or t
agcagcaagggaaagaaaacagtccaaggaaagganctatcacccttcaaaggcaggggaaaacatctcag

SEQ ID NO: 40093 - DNA, 71 bp, chicken (Gallus Gallus)
  misc_feature (36): n=a or g
tgtggtgacccaaaaagatcctgggatacagctacnaagtatataaaacaactggcacaggtgagcagcgc

SEQ ID NO: 40094 - DNA, 71 bp, chicken (Gallus Gallus)
  misc_feature (36): n=a or g
gttttccctcatcaacttaaagagctcaagggcagntgcccaccccaagactcattggcttaagggaaaag

SEQ ID NO: 40095 - DNA, 71 bp, chicken (Gallus Gallus)
  misc_feature (36): n=a or g
ggaaattcttgagttacacgtaattcagaagaacantttacagtgctaagaaggtttaactcataatgctg

SEQ ID NO: 40096 - DNA, 71 bp, chicken (Gallus Gallus)
  misc_feature (36): n=c or t
cattgcagcctggctgccacactgtgaagctaacanggggtgacatctggctcccagcatgccacgcacca

SEQ ID NO: 40097 - DNA, 71 bp, chicken (Gallus Gallus)
  misc_feature (36): n=a or g
attgcatcacgtggatgtgacgtctgcatccaggcnctggcataagcattgccagggcgggatgcttacat

SEQ ID NO: 40098 - DNA, 71 bp, chicken (Gallus Gallus)
  misc_feature (36): n=a or c
agttttctggcctctcccatcgcactacaatcactnagtacataaaatgcagaagtcacagtccccagtta

SEQ ID NO: 40099 - DNA, 71 bp, chicken (Gallus Gallus)
  misc_feature (36): n=a or g
cttgcaaggtcagctaattgagcaagagacttatcngggtggtaattagccaggtgattagccgttcatct

SEQ ID NO: 40100 - DNA, 71 bp, chicken (Gallus Gallus)
  misc_feature (36): n=a or g
tggctgcaggtcattgggcttgcaggtggctttggnagcagtgccgtggggacctcgggtttaattcgggg

SEQ ID NO: 40101 - DNA, 71 bp, chicken (Gallus Gallus)
  misc_feature (36): n=a or g
tcacaatgtgagtctgaacgatacaacagcatctcngagggaagcggggatgcagctgaacagccatggaa

SEQ ID NO: 40102 - DNA, 71 bp, chicken (Gallus Gallus)
  misc_feature (36): n=c or t
tacgatgcaattttggctgcgacagttctgttctgngcgcatgcagctctctcctggtaaaaactatacag

SEQ ID NO: 40103 - DNA, 71 bp, chicken (Gallus Gallus)
  misc_feature (36): n=a or g
tcccaaaaaaactccccagggtctctgggtcctggngaacgaatgtgatgatgaagaacatgattcccact

SEQ ID NO: 40104 - DNA, 71 bp, chicken (Gallus Gallus)
  misc_feature (36): n=a or g
ctgcgatgaaatcagatgaagttttccaagcgagcngaattcctctttacaaaagctcattgacggctgct

SEQ ID NO: 40105 - DNA, 71 bp, chicken (Gallus Gallus)
  misc_feature (36): n=a or g
gctctctgtctacatcaaatcagctatgaagagacntggacagggagtttgaacacaggccccttggcctc

SEQ ID NO: 40106 - DNA, 71 bp, chicken (Gallus Gallus)
  misc_feature (36): n=a or g
agtgaagggagcatccagctggagaacctctgcaangagccttctgcaaatcacctatgcaggatgcttgc

SEQ ID NO: 40107 - DNA, 71 bp, chicken (Gallus Gallus)
  misc_feature (36): n=g or t
atcaagcaacataacgtgatcttttacaagtatttngggaactgatgaccattaagtagccttaggaagaa

SEQ ID NO: 40108 - DNA, 71 bp, chicken (Gallus Gallus)
  misc_feature (36): n=a or g
gaatctgtgccggttctgatcagaaagaatgggaanaccaaaagcaaactcaaaacagcacctagactgaa

SEQ ID NO: 40109 - DNA, 71 bp, chicken (Gallus Gallus)
  misc_feature (36): n=c or t
tgcctgctcgcttgctgcaggagatctgctatttantcctgcagacttcagcatctttgcgtccatctcat

SEQ ID NO: 40110 - DNA, 71 bp, chicken (Gallus Gallus)
  misc_feature (36): n=a or g
cccttgaggtcagcgttttcatcttctctccctttnaaggtgtgcttttgactatcgaatctgaaccacta

SEQ ID NO: 40111 - DNA, 71 bp, chicken (Gallus Gallus)
  misc_feature (36): n=c or t
ggctgccaggatccatacccccttgtgctgcctgtntcttcccagcaaggggtgttgactgctgttgtgtt

SEQ ID NO: 40112 - DNA, 71 bp, chicken (Gallus Gallus)
  misc_feature (36): n=c or t
ttctcaaccatttctattcatataataaaagtcagngctgctgcttttttgacagatagccttagacccag

SEQ ID NO: 40113 - DNA, 71 bp, chicken (Gallus Gallus)
  misc_feature (36): n=c or t
agctcttctgctgttctgaaggctttgcagcaacangaggagccctgtgctgcaaaaaacctctctccaag

SEQ ID NO: 40114 - DNA, 71 bp, chicken (Gallus Gallus)
  misc_feature (36): n=a or g
gcacatcaccatgtggtgcagagcgctggtgctggngctgaaggtctcctccatggcttgagatcagaaat

SEQ ID NO: 40115 - DNA, 71 bp, chicken (Gallus Gallus)
  misc_feature (36): n=c or t
gcactgctacagctccataaagtttgcaccaaggcnttcttacactgtgcaggtgccagctgcaccccttg

SEQ ID NO: 40116 - DNA, 71 bp, chicken (Gallus Gallus)
  misc_feature (36): n=g or t
tgtggtaccagttagcttacagtcaccaaaagaacngtaataagagaaatataatctgctccacagagact

SEQ ID NO: 40117 - DNA, 71 bp, chicken (Gallus Gallus)
  misc_feature (36): n=c or t
gtgtgaaagcataagctagaaacacattccaacatntccaggaccagatgcctggaacagaagcgtcgtgc

SEQ ID NO: 40118 - DNA, 71 bp, chicken (Gallus Gallus)
  misc_feature (36): n=c or t
tccccacgaagcccccgtgctaaagaagatcctttnggataaagaggtcttcaggcaacagtgctaattcg

SEQ ID NO: 40119 - DNA, 71 bp, chicken (Gallus Gallus)
  misc_feature (36): n=c or t
aaagcagtggtgctggggttattagatatgtattangatgcagcattcgcagcgcagtgcttaaggataag

SEQ ID NO: 40120 - DNA, 71 bp, chicken (Gallus Gallus)
  misc_feature (36): n=a or c
gggaattttaaaatgaccatctgggggaaaggctcngagcgtgcagagcttaaccctggttgtggatcaga

SEQ ID NO: 40121 - DNA, 71 bp, chicken (Gallus Gallus)
  misc_feature (36): n=g or t
ttgagattatagagtcctgcattgcaatctggggtncaggtagccctatttgttaagatatgagctgcact

SEQ ID NO: 40122 - DNA, 71 bp, chicken (Gallus Gallus)
  misc_feature (36): n=a or g
tcatcactgatggctgcagcattgccaccctgattncagagggcagagcaggctcagcaaacacagctgca

SEQ ID NO: 40123 - DNA, 71 bp, chicken (Gallus Gallus)
  misc_feature (36): n=a or c
tgcttatttctcacctgttgacattggcatccctgnagaattcacaggtttccactatggttattgtgaga

SEQ ID NO: 40124 - DNA, 71 bp, chicken (Gallus Gallus)
  misc_feature (36): n=c or t
ggcaaccttattacagtgctcagcaaccagcacatnatgctgaaactctaattaaatactcgagatagcca

SEQ ID NO: 40125 - DNA, 71 bp, chicken (Gallus Gallus)
  misc_feature (36): n=c or t
ccaagcatcctaaaacccctgagtccaggccacatntacagctggcaaatgaaaagaatttcatagcacac

SEQ ID NO: 40126 - DNA, 71 bp, chicken (Gallus Gallus)
  misc_feature (36): n=a or g
tattattgttattattactatgaaaatctttaaacngcagtaaggacagatcagctactcctctgagacag

SEQ ID NO: 40127 - DNA, 71 bp, chicken (Gallus Gallus)
  misc_feature (36): n=g or t
tgattctattactgccttcactataacgtaccaacnggaggaaggcagccaagttttgctgagaacattta

SEQ ID NO: 40128 - DNA, 71 bp, chicken (Gallus Gallus)
  misc_feature (36): n=c or t
aacttcaactcttcaaatagcagttcctaaagcaangagcaactttaggatgtggagtgaaagatcttatg

SEQ ID NO: 40129 - DNA, 71 bp, chicken (Gallus Gallus)
  misc_feature (36): n=a or g
ttaggtgggcacagcgcagggaccttggctcatacncagtggtcacattgaaaattaattcttttttccac

SEQ ID NO: 40130 - DNA, 71 bp, chicken (Gallus Gallus)
  misc_feature (36): n=a or c
ctgtggttctgtgatttgaaagttgctgggcacctnagctcaccaagtcctccaagggataagtccttgca

SEQ ID NO: 40131 - DNA, 71 bp, chicken (Gallus Gallus)
  misc_feature (36): n=a or g
atgcaaaaacaagaattcaaacaacaccgtgaagcncaatcacctcaaaaagttccctctgcagagggttc

SEQ ID NO: 40132 - DNA, 71 bp, chicken (Gallus Gallus)
  misc_feature (36): n=a or g
ctatttgcactgcttacatcttcattaacagcatgnaaaggaaagaagcacatgattttgtctttagcaat

SEQ ID NO: 40133 - DNA, 71 bp, chicken (Gallus Gallus)
  misc_feature (36): n=a or g
gcagttgtccaatgcagaacattaacactgaaatcntgtccacttacctaaaggaaacaggaagataaaag

SEQ ID NO: 40134 - DNA, 71 bp, chicken (Gallus Gallus)
  misc_feature (36): n=a or g
gctaaaacaaaccctggcagattacctgctgctaantgaccaggagatcacagaatgccaattgcaagacc

SEQ ID NO: 40135 - DNA, 71 bp, chicken (Gallus Gallus)
  misc_feature (36): n=c or t
aaaactcttctttttctttagatccatcacttttanaatccgtgccttaacttgccctcgttgcttatatc

SEQ ID NO: 40136 - DNA, 71 bp, chicken (Gallus Gallus)
  misc_feature (36): n=c or t
agtgcgagtacaaattgaagggacactgctgcaagngagctaaatataagtgccccaagagcagcatttcc

SEQ ID NO: 40137 - DNA, 71 bp, chicken (Gallus Gallus)
  misc_feature (36): n=g or t
tccctgcagcccagagcgtccttctgcagtgccggngtaacgctactgatggaccccatgggacatcacag

SEQ ID NO: 40138 - DNA, 71 bp, chicken (Gallus Gallus)
  misc_feature (36): n=a or g
ggcataaatgagtcctctttgcttggcagatttagnagtatatatggaaggaggaggggcagaagctcgtt

SEQ ID NO: 40139 - DNA, 71 bp, chicken (Gallus Gallus)
  misc_feature (36): n=a or g
tataattacaggatatttaacaaataaggcagagangggtggaaccggtgcgagatgaggctggtggcaga

SEQ ID NO: 40140 - DNA, 71 bp, chicken (Gallus Gallus)
  misc_feature (36): n=c or t
ctcgagcgagaagtacagggcagaagtattcacacncctctacttgtcttactgcaccctaagagccacat

SEQ ID NO: 40141 - DNA, 71 bp, chicken (Gallus Gallus)
  misc_feature (36): n=c or t
gtgccaagccaccagcaatgctgtccagagagaaanctgtggggactaatccatgaccattagctactctg

SEQ ID NO: 40142 - DNA, 71 bp, chicken (Gallus Gallus)
  misc_feature (36): n=a or g
gcaccatggacgtgtgtgtggggtggtggtgagacntgtaaccccactgtgagcctgctgtccgctgtcac

SEQ ID NO: 40143 - DNA, 71 bp, chicken (Gallus Gallus)
  misc_feature (36): n=c or t
agaaaaaagcatgaaggaatcaatctacaaagaganattccctaagtatcttaaagcatcataattctgca

SEQ ID NO: 40144 - DNA, 71 bp, chicken (Gallus Gallus)
  misc_feature (36): n=a or g
caaataattgcttacatccaccaggcacagatcagnagcagattggcacaaccactcttgagggtttaact

SEQ ID NO: 40145 - DNA, 71 bp, chicken (Gallus Gallus)
  misc_feature (36): n=a or g
cgccgatagaaaacaaactaatgggctgcatcgagnagggagagaacatagctcccacagagcactgcttg

SEQ ID NO: 40146 - DNA, 71 bp, chicken (Gallus Gallus)
  misc_feature (36): n=a or g
ccacagaagctaagccagttctctcagaagggatcntcctcccctggttaaagcacagacatctcctacct

SEQ ID NO: 40147 - DNA, 71 bp, chicken (Gallus Gallus)
  misc_feature (36): n=a or g
gtagtttggggttgcaatgactcagactgagatacnttctcagatagagatggtgaaatatttgataaaaa

SEQ ID NO: 40148 - DNA, 71 bp, chicken (Gallus Gallus)
  misc_feature (36): n=g or t
tcttgaaagggtgcctgaattgaaagggaaaaaatnattacaccatcaaagttgaatgaaagctcttcatt

SEQ ID NO: 40149 - DNA, 71 bp, chicken (Gallus Gallus)
  misc_feature (36): n=a or g
gagtccatgtctgtgcagagctaaagttgctgtgtnttctcacactgtttttgctacacagccaggatgtc

SEQ ID NO: 40150 - DNA, 71 bp, chicken (Gallus Gallus)
  misc_feature (36): n=c or t
ctcccctctggtctgattgatgactctgtcagcccngagaaggtctctcagacaaatgatgtgcccaagac

SEQ ID NO: 40151 - DNA, 71 bp, chicken (Gallus Gallus)
  misc_feature (36): n=a or g
gctcactctgtagatgtctccattaagtgacagtanggttctaatgaaccccataattacccatttccact

SEQ ID NO: 40152 - DNA, 71 bp, chicken (Gallus Gallus)
  misc_feature (36): n=a or c
agcatccctgggaagcttgagggacccaaaaccatnaggagattgcaccttcccatggcacccaaggggca

SEQ ID NO: 40153 - DNA, 71 bp, chicken (Gallus Gallus)
  misc_feature (36): n=c or t
gtctcttatttgtatttattcctgtatgtgggaaantgtatgaggcagcagctgtaagctgttgtgaatcc

SEQ ID NO: 40154 - DNA, 71 bp, chicken (Gallus Gallus)
  misc_feature (36): n=a or g
aattaaagtgtaccggtactgaaaggtgggacttgntgttttcagccctcggctctgggcacaggacctgg

SEQ ID NO: 40155 - DNA, 71 bp, chicken (Gallus Gallus)
  misc_feature (36): n=c or t
tcattggaacacttcagctgcaagacacaaagcaangccatcaggagctggtcagaagcccctgcctccag

SEQ ID NO: 40156 - DNA, 71 bp, chicken (Gallus Gallus)
  misc_feature (36): n=c or t
atcccctcatgatttatttaagcccctgggcagttnaaatggcagtgcaggcaccatggagaacctcactg

SEQ ID NO: 40157 - DNA, 71 bp, chicken (Gallus Gallus)
  misc_feature (36): n=c or t
gagcactaacagtctttctgctaatgaagggagagnccttggagcaagaagtgacacctctgagcatcacg

SEQ ID NO: 40158 - DNA, 71 bp, chicken (Gallus Gallus)
  misc_feature (36): n=a or g
aactcctgtttttcacgccaactcaccgtgctctcncaggacgcatttgcaggatgcacgagactcgagct

SEQ ID NO: 40159 - DNA, 71 bp, chicken (Gallus Gallus)
  misc_feature (36): n=c or t
cacgtttgcttccaaggaggttccacttcccttccngcttcaataaagacaaagggacagataaattgaga

SEQ ID NO: 40160 - DNA, 71 bp, chicken (Gallus Gallus)
  misc_feature (36): n=c or t
gctgggaacctcagaatggccatatacatcaggganggatgattctgagtacggacaagatttgtgaataa

SEQ ID NO: 40161 - DNA, 71 bp, chicken (Gallus Gallus)
  misc_feature (36): n=a or c
cacatcacttcccaacacaagaagcacaagtttccnactctgacacagtcaaggaggacggaaccaaccca

SEQ ID NO: 40162 - DNA, 71 bp, chicken (Gallus Gallus)
  misc_feature (36): n=a or g
ctttttggagatgaaggagacttgtactggaaagangtcatttggctgccctgctatgctgaactccaggc

SEQ ID NO: 40163 - DNA, 71 bp, chicken (Gallus Gallus)
  misc_feature (36): n=g or t
atctggaaaccacttttttattgcacctctaagaantccacccaactctttgaattaatagttactggaaa

SEQ ID NO: 40164 - DNA, 71 bp, chicken (Gallus Gallus)
  misc_feature (36): n=g or t
aaattgtctgtaaccatagataagcatttatctatncagcaaaagttgtatttcatatggaaagtccttac

SEQ ID NO: 40165 - DNA, 71 bp, chicken (Gallus Gallus)
  misc_feature (36): n=g or t
aaaaacccgcatttctgtgttcaggaactgtctgtnttatatccatgagtaatatgaaatgaaaatatttc

SEQ ID NO: 40166 - DNA, 71 bp, chicken (Gallus Gallus)
  misc_feature (36): n=c or t
tgatgagtcagagccctgggttcccgtgcacagagnaggggcagcagcagggcgagctcaccgcctgcagt

SEQ ID NO: 40167 - DNA, 71 bp, chicken (Gallus Gallus)
  misc_feature (36): n=a or c
tcatgctgggaggaatgaaacagagcccagcagagntgaggtcggacccttctatctgtacatcacacctc

SEQ ID NO: 40168 - DNA, 71 bp, chicken (Gallus Gallus)
  misc_feature (36): n=c or t
agagggagaaagacaactcagctctatcatttctgntgtctcactgcccagagatggggtcaccgtccctg

SEQ ID NO: 40169 - DNA, 71 bp, chicken (Gallus Gallus)
  misc_feature (36): n=c or t
actggaaggagcaataaaagcagtcaataatagatngcagtgccaagccctgtcggtaggcctggatgatc

SEQ ID NO: 40170 - DNA, 71 bp, chicken (Gallus Gallus)
  misc_feature (36): n=c or t
ttgtgattgtacaggaatacttcagcacactatgantgagtcaatgcgtaagctccttattttcactttct

SEQ ID NO: 40171 - DNA, 71 bp, chicken (Gallus Gallus)
  misc_feature (36): n=a or g
tacttaccaccggttctggtgtcttgagagaagatnagctcttctttgtcactctcattttcgggaagggg

SEQ ID NO: 40172 - DNA, 71 bp, chicken (Gallus Gallus)
  misc_feature (36): n=c or t
gtaggatcggctgccggagtctgaacataattggtngcctcacccaagtcatcttctgtgacggacagcgg

SEQ ID NO: 40173 - DNA, 71 bp, chicken (Gallus Gallus)
  misc_feature (36): n=a or g
aggaaggtaaccaagataaaatcccagtaagacaangcaagaaaatcacaagcatacagatctcagctact

SEQ ID NO: 40174 - DNA, 71 bp, chicken (Gallus Gallus)
  misc_feature (36): n=c or t
ccagcagaacaagtagaagaagtgatgatggtactnacgagaaggcagctttgccctcctccatgtctttg

SEQ ID NO: 40175 - DNA, 71 bp, chicken (Gallus Gallus)
  misc_feature (36): n=c or t
gtgtcatctcctgaaccgggaggaaacgcggcaccnatgacgctgctgctcagcttgtttcacatggcctg

SEQ ID NO: 40176 - DNA, 71 bp, chicken (Gallus Gallus)
  misc_feature (36): n=a or g
cacaggaccctcaaagagtcctttgttaggatggangcttgtgcataaataggtttcagaagcgcagagaa

SEQ ID NO: 40177 - DNA, 71 bp, chicken (Gallus Gallus)
  misc_feature (36): n=c or t
cgtgtcaccagtcccctggcactgtgaggatgctantgcatttactaaatttaaaccaattccagaaggct

SEQ ID NO: 40178 - DNA, 71 bp, chicken (Gallus Gallus)
  misc_feature (36): n=a or g
ttcttgtaaaccatcctactatctaaggtttaaganggcagaacaaaaggggcacagaaataaacattgga

SEQ ID NO: 40179 - DNA, 71 bp, chicken (Gallus Gallus)
  misc_feature (36): n=c or t
ggcagtaaaatattatctcctgaacaaactcagctnacccatctagagtagctttctaaatgcttgcccct

SEQ ID NO: 40180 - DNA, 71 bp, chicken (Gallus Gallus)
  misc_feature (36): n=g or t
cataaaaccatcattcctttactctctgatgatgangaggaggaagagcagtcctatctctatccagctat

SEQ ID NO: 40181 - DNA, 71 bp, chicken (Gallus Gallus)
  misc_feature (36): n=a or g
gatggaaatcactatctgcactcagctggaaaaaanacctgaaaactaccagcagttccccctgggacaca

SEQ ID NO: 40182 - DNA, 71 bp, chicken (Gallus Gallus)
  misc_feature (36): n=a or g
gggagaaaaataaggtgctgtaaatgctcagtttcngttactccctccccaaacacccaggaattacctga

SEQ ID NO: 40183 - DNA, 71 bp, chicken (Gallus Gallus)
  misc_feature (36): n=a or g
ttttgtttttaatcagcagcagttcctgctgtgggntgagattggatgggcccctgaatgtcttgatttta

SEQ ID NO: 40184 - DNA, 71 bp, chicken (Gallus Gallus)
  misc_feature (36): n=c or t
ttatcagaggttataagtacttccatgagcctcacnacagcagtttgtgctctgacactgcaagtttggcc

SEQ ID NO: 40185 - DNA, 71 bp, chicken (Gallus Gallus)
  misc_feature (36): n=a or c
gggaagtcgagaactcttgactaaatgatgccaacntgaagaagcagccaacttttaaacacactctgaga

SEQ ID NO: 40186 - DNA, 71 bp, chicken (Gallus Gallus)
  misc_feature (36): n=c or t
tcagttcctctaacctttaggtcttgattttcttcnacactctggtccagacgacttcggattatgatctg

SEQ ID NO: 40187 - DNA, 71 bp, chicken (Gallus Gallus)
  misc_feature (36): n=c or t
gactgcatcctgcaaaaagcacagcccttacgctangccaacatttagtgctgctgtacatcacacaataa

SEQ ID NO: 40188 - DNA, 71 bp, chicken (Gallus Gallus)
  misc_feature (36): n=a or g
ggaaagactgtaagagctggccagcttaaattctcngcaattgctccacagccccgaagaaatggcaccat

SEQ ID NO: 40189 - DNA, 71 bp, chicken (Gallus Gallus)
  misc_feature (36): n=a or g
gaagaaaaaagtaactctgtggttgaggccaagctnctgtatgcttgctcacacagataatgaaacctttt

SEQ ID NO: 40190 - DNA, 71 bp, chicken (Gallus Gallus)
  misc_feature (36): n=a or g
ggacaaaattaaaaccagcatacattctcttcaccngactatttcggattttaagctgagcatcagtctgc

SEQ ID NO: 40191 - DNA, 71 bp, chicken (Gallus Gallus)
  misc_feature (36): n=c or t
gccaacatgcaaaacccgctcatgaattaaccaccnctttctaatcactcccacttgatatttatcatggg

SEQ ID NO: 40192 - DNA, 71 bp, chicken (Gallus Gallus)
  misc_feature (36): n=c or t
aatagcttgtatgaataaaaatgcctgtatgaatanatgcaatcaggagcctacaggaaataaacagcagg

SEQ ID NO: 40193 - DNA, 71 bp, chicken (Gallus Gallus)
  misc_feature (36): n=a or g
gacactctgcttagctagaaatgttgcttcaaagantcagctactactgctctgccgttagtagaaactcc

SEQ ID NO: 40194 - DNA, 71 bp, chicken (Gallus Gallus)
  misc_feature (36): n=c or t
ccgagaaagcagtcagttttgacacggttttcattnagagaacctcttcccttttgcgagggaaaagtgct

SEQ ID NO: 40195 - DNA, 71 bp, chicken (Gallus Gallus)
  misc_feature (36): n=c or t
aacaagaaccgatttttaggccaacgttgtgagatntacgtgacagcagtcaagaataaaactagcttttg

SEQ ID NO: 40196 - DNA, 71 bp, chicken (Gallus Gallus)
  misc_feature (36): n=c or t
cagcacatgcagggagattgggggcactgaaccaanagtgagacaagaagtcaatgtttacttgaagaggt

SEQ ID NO: 40197 - DNA, 71 bp, chicken (Gallus Gallus)
  misc_feature (36): n=c or t
aacacacgttatccgctctcagcatcgcacgtcccngccgtcctttttccatccagaagccagctgcactc

SEQ ID NO: 40198 - DNA, 71 bp, chicken (Gallus Gallus)
  misc_feature (36): n=a or g
ccagagaaaattccagtctgattctttttctagggncaaaacccagttgtctgggcacgctgattatcaca

SEQ ID NO: 40199 - DNA, 71 bp, chicken (Gallus Gallus)
  misc_feature (36): n=c or t
gtgggcaccacagcgctcagacccatcacaatgganactattcagaccatcgaagcaggacagtgccggaa

SEQ ID NO: 40200 - DNA, 71 bp, chicken (Gallus Gallus)
  misc_feature (36): n=a or g
agggagcagagcagcgcagaccctgtgagcggagcncaggtgttgcatggcttacacaggaactgaaaagc

SEQ ID NO: 40201 - DNA, 71 bp, chicken (Gallus Gallus)
  misc_feature (36): n=a or g
ggaaagtgggacaaggagcaaatgaaatcatctcantgcttaatacacagaggtctgcactgccagaagtc

SEQ ID NO: 40202 - DNA, 71 bp, chicken (Gallus Gallus)
  misc_feature (36): n=a or g
cagtaggatccataagagttgatctgagccctcccngccatttgcatttccaaaaaagtgccccagagcat

SEQ ID NO: 40203 - DNA, 71 bp, chicken (Gallus Gallus)
  misc_feature (36): n=c or t
ccattacagcatggtgctgcagtgatatccccaccngagaagcatctcttttcctaaagctctctgagggt

SEQ ID NO: 40204 - DNA, 71 bp, chicken (Gallus Gallus)
  misc_feature (36): n=a or g
cagcggccgttgggaagccgacggctttctacatcnatggaggcagtaaatttcaggtctttcttttcatt

SEQ ID NO: 40205 - DNA, 71 bp, chicken (Gallus Gallus)
  misc_feature (36): n=c or t
gccagccgtggcaattgggcctttggaccaggacanggaattgcttttccttctatttacccaataaataa

SEQ ID NO: 40206 - DNA, 71 bp, chicken (Gallus Gallus)
  misc_feature (36): n=a or c
agtccttgcatcttctggaaagaacgtctgaggagnaccagagtggtgtgaattcaggattatgttaatta

SEQ ID NO: 40207 - DNA, 71 bp, chicken (Gallus Gallus)
  misc_feature (36): n=c or t
gcactgaaagcctcctgtgccctttggaagtgccangaccgttagggctggaattactgctgggcaaaggg

SEQ ID NO: 40208 - DNA, 71 bp, chicken (Gallus Gallus)
  misc_feature (36): n=a or g
tgatggatccagaatgttctacctcatgtcaaaatnggaaattcagcaagatggaaaggttttcgtccctc

SEQ ID NO: 40209 - DNA, 71 bp, chicken (Gallus Gallus)
  misc_feature (36): n=c or t
ccaggtgccatcattcccttcccatgtgtaaccctnttccaacttccagggtaatcctggggcacataggg

SEQ ID NO: 40210 - DNA, 71 bp, chicken (Gallus Gallus)
  misc_feature (36): n=a or g
gccctgcccccagggaatcactaatcagaggctgtngggctgaaatttagcctggcaaaacactgttggag

SEQ ID NO: 40211 - DNA, 71 bp, chicken (Gallus Gallus)
  misc_feature (36): n=a or g
ggctgttgcttaatatgaagcactcggcagactgancccctctgcatctgctgtgctgagagcaaagtgac

SEQ ID NO: 40212 - DNA, 71 bp, chicken (Gallus Gallus)
  misc_feature (36): n=c or t
ctttttcattcatctgtaatcatcattactacatgnattattcttaggatcacctattatcataattaaag

SEQ ID NO: 40213 - DNA, 71 bp, chicken (Gallus Gallus)
  misc_feature (36): n=a or g
tttgtcaaaaatcatttaaagtcacacttccatgtnaccatagggattttccatggtcccacatggatttg

SEQ ID NO: 40214 - DNA, 71 bp, chicken (Gallus Gallus)
  misc_feature (36): n=c or t
cacacagagatggaggacagatctaggcagatctgnttgctttttttccagcattctatacctcttactgg

SEQ ID NO: 40215 - DNA, 71 bp, chicken (Gallus Gallus)
  misc_feature (36): n=g or t
cagacactgcatggcaacgcccagccctcagtgtgncactctcactgcctctcgagcttgtttcacacccc

SEQ ID NO: 40216 - DNA, 71 bp, chicken (Gallus Gallus)
  misc_feature (36): n=c or t
actgatttgctgagggcagcgtttaccagttacaangttcagttcccggtagggctgatttgtacctggtt

SEQ ID NO: 40217 - DNA, 71 bp, chicken (Gallus Gallus)
  misc_feature (36): n=c or t
aaaagttcaaaggtctgcagatattacccccaaatnttgctgatccaagcagagaaagatttcctttctgt

SEQ ID NO: 40218 - DNA, 71 bp, chicken (Gallus Gallus)
  misc_feature (36): n=g or t
acttggcctaagatgactcagaatattgtgattttnagaaaatacactctcaagtttatggcctcctaggt

SEQ ID NO: 40219 - DNA, 71 bp, chicken (Gallus Gallus)
  misc_feature (36): n=a or g
atgttgatgcaaggacaccagagcccaacctgaccngtgcacaggtgctcactgcagcactggccacacaa

SEQ ID NO: 40220 - DNA, 71 bp, chicken (Gallus Gallus)
  misc_feature (36): n=c or t
gctatttgagtaaacaaaactgctgtaactttctcngctcgggggttgggaggttggggcgggttgctgtc

SEQ ID NO: 40221 - DNA, 71 bp, chicken (Gallus Gallus)
  misc_feature (36): n=g or t
tgaagctgatggagcctttccctctggtaaagactncggcagaataggcgctggccttctgcgaatacagt

SEQ ID NO: 40222 - DNA, 71 bp, chicken (Gallus Gallus)
  misc_feature (36): n=g or t
cacttagatcataaagaaggaagagctcattttgcngaatgtatcactgtgagagggatgagtgggtgctg

SEQ ID NO: 40223 - DNA, 71 bp, chicken (Gallus Gallus)
  misc_feature (36): n=a or c
gaaataaaggggataaatcttcagaaggtccacctncacttgctcaccaacctggaagaagattgtgacat

SEQ ID NO: 40224 - DNA, 71 bp, chicken (Gallus Gallus)
  misc_feature (36): n=g or t
aagattaaatcttgatgaaggatatggcattgtgancacaatgtgtgatgaaacattccttactgttctga

SEQ ID NO: 40225 - DNA, 71 bp, chicken (Gallus Gallus)
  misc_feature (36): n=g or t
atggccatatatcatcaggagactaaagagtgctcntgtctgcactctgccctccctttaagtgtgtgctc

SEQ ID NO: 40226 - DNA, 71 bp, chicken (Gallus Gallus)
  misc_feature (36): n=a or g
tatggaacacagcagggaaagtaagaattgaaaacngcctctcaactgacagtacaagggaaaagactgca

SEQ ID NO: 40227 - DNA, 71 bp, chicken (Gallus Gallus)
  misc_feature (36): n=g or t
atacataattcaggggaggcaagtgaagaaatgcanggctttcacaagagaaaatacttgagcctttcaca

SEQ ID NO: 40228 - DNA, 71 bp, chicken (Gallus Gallus)
  misc_feature (36): n=c or t
acagtgctggtctttccttggtaatctcatgtcaancccctgtgcaatgatttgctcaactgtctattgat

SEQ ID NO: 40229 - DNA, 71 bp, chicken (Gallus Gallus)
  misc_feature (36): n=a or g
gcctgcatttccccaggaaaccatggacaaaggggngggatggatggcacacactgctttactgaagtgtg

SEQ ID NO: 40230 - DNA, 71 bp, chicken (Gallus Gallus)
  misc_feature (36): n=a or g
gcaggggggaagcaatgctggagaaggagagatccnccacaccaacaattccttatgcacacagaagttca

SEQ ID NO: 40231 - DNA, 71 bp, chicken (Gallus Gallus)
  misc_feature (36): n=a or g
ctgattacaataatttaccctgtgagaggtgcctcntttgtagggcttgaagctctttgcaatgaccctgt

SEQ ID NO: 40232 - DNA, 71 bp, chicken (Gallus Gallus)
  misc_feature (36): n=c or t
catctttgtaaaggccacagatgcagcggatgacancctcatccttctcgtgcccattctccttctcgcag

SEQ ID NO: 40233 - DNA, 71 bp, chicken (Gallus Gallus)
  misc_feature (36): n=c or t
cggtggcttcattttgatcgatgacctcatctgccntttaggcctccctctctttttaggaaaagcttgtc

SEQ ID NO: 40234 - DNA, 71 bp, chicken (Gallus Gallus)
  misc_feature (36): n=c or t
actctgcacagacaacaaaaatgctaatcctggacntaatcatcattttcccttgatcactgtaatcttct

SEQ ID NO: 40235 - DNA, 71 bp, chicken (Gallus Gallus)
  misc_feature (36): n=c or t
aaaagaagtaatttaaatccctccgtggggatggcngcctttgtattactccattgatttcgttgctgttg

SEQ ID NO: 40236 - DNA, 71 bp, chicken (Gallus Gallus)
  misc_feature (36): n=a or g
aactgagaagtaggatatctcactgcttctcagggntttagagaaaggagatgcctccttacctctgcaat

SEQ ID NO: 40237 - DNA, 71 bp, chicken (Gallus Gallus)
  misc_feature (36): n=a or g
tacttccattgccagggccttttttaagcaccactntctattttagacgaagctttttctgccaaggttgc

SEQ ID NO: 40238 - DNA, 71 bp, chicken (Gallus Gallus)
  misc_feature (36): n=c or t
actgatggttgcagcacagtcacgtttcccacactngagcagctttccatcaatggtaaggcttttgggac

SEQ ID NO: 40239 - DNA, 71 bp, chicken (Gallus Gallus)
  misc_feature (36): n=a or c
aggagtgggcaagccatggggcacccctttgcaagntgccacaagtcctcaccctgtccttttcttttctg

SEQ ID NO: 40240 - DNA, 71 bp, chicken (Gallus Gallus)
  misc_feature (36): n=c or t
tccatctctgcatgcttgcattggtggggaagtaangctgagctgggctgtacatcctctatcacattcaa

SEQ ID NO: 40241 - DNA, 71 bp, chicken (Gallus Gallus)
  misc_feature (36): n=c or t
aggtctttaaggcagagcagccccagataactgagngctttatgaagtgtttagcactgaagcttgcagca

SEQ ID NO: 40242 - DNA, 71 bp, chicken (Gallus Gallus)
  misc_feature (36): n=a or c
acttcgtcccttgctttgtggcaaagccgtctgccntggcttcgagcaaacctttctctgtgctcgagcag

SEQ ID NO: 40243 - DNA, 71 bp, chicken (Gallus Gallus)
  misc_feature (36): n=c or t
ctgaatgatcccgcactcttaccacactcctctccncccatccctccattatgctgaacataacccctaag

SEQ ID NO: 40244 - DNA, 71 bp, chicken (Gallus Gallus)
  misc_feature (36): n=c or t
tatgggggtgctcatcctgctcacttccggggtgcntttgtagggctggcagtgggtttacggcgctcctc

SEQ ID NO: 40245 - DNA, 71 bp, chicken (Gallus Gallus)
  misc_feature (36): n=a or g
agcccggccacggccatctgagcggcttggtgttgnatctgcagggatctaagcagggccacagggctccc

SEQ ID NO: 40246 - DNA, 71 bp, chicken (Gallus Gallus)
  misc_feature (36): n=c or t
actgctctcccttttaattgtgcccctgatgtgttnctctgacacagagctctcacgtggagatgtggaga

SEQ ID NO: 40247 - DNA, 71 bp, chicken (Gallus Gallus)
  misc_feature (36): n=g or t
gaaagggatccacaaaccgctgcagaaaggccccantgatatcctcctcttccgctccttaaacaaaaccc

SEQ ID NO: 40248 - DNA, 71 bp, chicken (Gallus Gallus)
  misc_feature (36): n=c or t
cctttgcctccagatgaagctcgtgattcttgctgngtttgccctcttttatgtggcccgctgtgaggagg

SEQ ID NO: 40249 - DNA, 71 bp, chicken (Gallus Gallus)
  misc_feature (36): n=a or g
gtgtgagctccactaagctcagagctctgaactcanacacacagacacaaacttgctccagtaaccagagt

SEQ ID NO: 40250 - DNA, 71 bp, chicken (Gallus Gallus)
  misc_feature (36): n=c or t
ttccttgggagagagaagcagttctgattaggccangtgtcaaatcaggtcaggcaaggtctgtaattgcc

SEQ ID NO: 40251 - DNA, 71 bp, chicken (Gallus Gallus)
  misc_feature (36): n=a or g
tcaatctcaccatcgtgaattagccaaagtactctntaagtggggatgaaccttcggacctccatcacaca

SEQ ID NO: 40252 - DNA, 71 bp, chicken (Gallus Gallus)
  misc_feature (36): n=g or t
tgtgatgtgggcgatacgtgaagtgtgttcagctcngctgatccccggccctgcagcatttaaagctctca

SEQ ID NO: 40253 - DNA, 71 bp, chicken (Gallus Gallus)
  misc_feature (36): n=a or g
agatgcacgtttttgctgggctgtctgtgtgcttcntgggctggttcaccaacagctctgtgttcattggg

SEQ ID NO: 40254 - DNA, 71 bp, chicken (Gallus Gallus)
  misc_feature (36): n=a or g
gcagaaaatcggtgcggtggtgcggaatcttcagcntgaactggaggagagtgccgaggagacggggcatt

SEQ ID NO: 40255 - DNA, 71 bp, chicken (Gallus Gallus)
  misc_feature (36): n=a or g
tcagtgatagattttatttcgtccctttttatagcntggtgcaagagttgagcaagagtctgcttcacttt

SEQ ID NO: 40256 - DNA, 71 bp, chicken (Gallus Gallus)
  misc_feature (36): n=c or t
attttatatgcttgctaattcaatgcaggaaaactngtctgctgggtttgtgtgtgcctggagaggaacca

SEQ ID NO: 40257 - DNA, 71 bp, chicken (Gallus Gallus)
  misc_feature (36): n=c or t
ttttttgtgcgtttaaaacagacacagcactaccanggccctctgaaataagtccaaggcctgcagatcct

SEQ ID NO: 40258 - DNA, 71 bp, chicken (Gallus Gallus)
  misc_feature (36): n=c or t
ccccaggaccgtttcaagcagcgcctggagatgccnaacaccacagcactgaggattggggccctggagct

SEQ ID NO: 40259 - DNA, 71 bp, chicken (Gallus Gallus)
  misc_feature (36): n=c or t
ttttaagtcaaagctacagaatttcctggaattctngatcccttttcatgccaaattcagcagggggaaaa

SEQ ID NO: 40260 - DNA, 71 bp, chicken (Gallus Gallus)
  misc_feature (36): n=a or c
ccagcaagacccagtctgagtccagccaagtcaacnatcaggaaaggtcctggcagggtttggaacagaaa

SEQ ID NO: 40261 - DNA, 71 bp, chicken (Gallus Gallus)
  misc_feature (36): n=c or t
tggggttttactctgaaagcagagggccaccagctntctgcgacgtgttatcaagcttgaaataggaggca

SEQ ID NO: 40262 - DNA, 71 bp, chicken (Gallus Gallus)
  misc_feature (36): n=c or t
gagttaaaagctagaggatttgtttagatctgctcngcagaggggggttacttcaacaaacacaccacgac

SEQ ID NO: 40263 - DNA, 71 bp, chicken (Gallus Gallus)
  misc_feature (36): n=c or t
tggggggccacactgtccaccctatgagccctcagnccttttgggacccgatttgggattatttttgcatt

SEQ ID NO: 40264 - DNA, 71 bp, chicken (Gallus Gallus)
  misc_feature (36): n=g or t
gctccccaacagaaatggagtgggaatgcgtgctcnatgccaccagaagtcaaactgaatgtcagtaatga

SEQ ID NO: 40265 - DNA, 71 bp, chicken (Gallus Gallus)
  misc_feature (36): n=c or t
accccaaggacaggcatctctttggtgtcccctcantgccatcacccccagggggcaggaatcactttggt

SEQ ID NO: 40266 - DNA, 71 bp, chicken (Gallus Gallus)
  misc_feature (36): n=a or g
gagatggccaagcccttggggataaacaggctgggnaaaagaaaacaatggagttttgctcttcggggctg

SEQ ID NO: 40267 - DNA, 71 bp, chicken (Gallus Gallus)
  misc_feature (36): n=c or t
ttttcaccccatgtgagcaggtccagcaccaaaccnccttttatgctctgcaaatctggaatgaggacatc

SEQ ID NO: 40268 - DNA, 71 bp, chicken (Gallus Gallus)
  misc_feature (36): n=a or g
gcaggatgtgctgcaataatccatgccacggaggantggatgcgctgcctgctgtcaacttatattgcagc

SEQ ID NO: 40269 - DNA, 71 bp, chicken (Gallus Gallus)
  misc_feature (36): n=c or t
catctctcattcattcccacatcccctcctttactncttttatttccagcccatcttttgatagctagaaa

SEQ ID NO: 40270 - DNA, 71 bp, chicken (Gallus Gallus)
  misc_feature (36): n=a or g
tcggcccatgaccaggtggggaaaacatgtcctcantttgcattttcaggctgattttcattaaaagggag

SEQ ID NO: 40271 - DNA, 71 bp, chicken (Gallus Gallus)
  misc_feature (36): n=g or t
acacagtgcttgtattgtgggaccagaaaatgtttngggaataaaagagactgagagagaagaggagctcc

SEQ ID NO: 40272 - DNA, 71 bp, chicken (Gallus Gallus)
  misc_feature (36): n=a or g
tgtgaaacatttgcagtcctcagcattcccatggcntttaattacacagggtgtttccagaaacacctcat

SEQ ID NO: 40273 - DNA, 71 bp, chicken (Gallus Gallus)
  misc_feature (36): n=a or g
gcacaggagggaaagagcatggagggagcagaacanatgagaggcacccagctcaccatgtgatgaccaga

SEQ ID NO: 40274 - DNA, 71 bp, chicken (Gallus Gallus)
  misc_feature (36): n=c or t
cagaacactgctgtgggatcttcagcatctgctgcngttggcaacatcctgagtgctgaaggtgtgcccat

SEQ ID NO: 40275 - DNA, 71 bp, chicken (Gallus Gallus)
  misc_feature (36): n=a or g
cctactgaaccaatctctgtaattaaatacagtttnaagttgcacctgaggatacagataggaacaaaaca

SEQ ID NO: 40276 - DNA, 71 bp, chicken (Gallus Gallus)
  misc_feature (36): n=a or g
gatctccttacacactccatctgaagcacctcagcnccaagggtggaatttccaagttgctccttccttgt

SEQ ID NO: 40277 - DNA, 71 bp, chicken (Gallus Gallus)
  misc_feature (36): n=a or g
tgctggcagttggtgtgttctcgtgtcgttgatggngtacagctcctcaaggcagagctccccacggcaca

SEQ ID NO: 40278 - DNA, 71 bp, chicken (Gallus Gallus)
  misc_feature (36): n=a or c
acggtcgaggtgggtccagcctacaccaatactttntttgggaccctgacagttctccccgtgcgaggttc

SEQ ID NO: 40279 - DNA, 71 bp, chicken (Gallus Gallus)
  misc_feature (36): n=a or c
agaactacagctgctctggccatttatgattacagntattatatctgtttgcttttgtaagtctcacagat

SEQ ID NO: 40280 - DNA, 71 bp, chicken (Gallus Gallus)
  misc_feature (36): n=c or t
gagcctcagctgggcggacacggctgcgtgctgctntgtttgccccgactccaccttttcaaagaaaaaga

SEQ ID NO: 40281 - DNA, 71 bp, chicken (Gallus Gallus)
  misc_feature (36): n=c or t
cctctacacactgctattcattcagttcactgtaanttgtgcccacagctttttgtaggcagagacacctt

SEQ ID NO: 40282 - DNA, 71 bp, chicken (Gallus Gallus)
  misc_feature (36): n=a or c
ggggaatgtggagaggggcgaaggcaaaaacccaancgcggcactacggggaaaagggaaatggggacgaa

SEQ ID NO: 40283 - DNA, 71 bp, chicken (Gallus Gallus)
  misc_feature (36): n=a or g
gtttgggcttaagctgtgctcctgggggcaccgacnccatccctgtgccgcacccgcacagctcaacccca

SEQ ID NO: 40284 - DNA, 71 bp, chicken (Gallus Gallus)
  misc_feature (36): n=a or g
caccgtcatgccaaccgatccgcgctctgttaactntgcccgtttgctcccctcagttggttgctgcatct

SEQ ID NO: 40285 - DNA, 71 bp, chicken (Gallus Gallus)
  misc_feature (36): n=a or g
gcatttgggaacgaaacgaattctggatgcctttanaggtgcaaaaacccatcagtggtaagaaatcctgg

SEQ ID NO: 40286 - DNA, 71 bp, chicken (Gallus Gallus)
  misc_feature (36): n=a or g
aaataaaagccgcgttcgtctttgggcagcggagcnttatacaaatatgtgctcaaggctctcagtgcttt

SEQ ID NO: 40287 - DNA, 71 bp, chicken (Gallus Gallus)
  misc_feature (36): n=c or t
aaatgagctctcatcttctgcggaggagaagttcanggagagagatggaggaaaagcgaagggaaattaag

SEQ ID NO: 40288 - DNA, 71 bp, chicken (Gallus Gallus)
  misc_feature (36): n=g or t
tttggaatgctgttagaaatgccatatctttctatntggttccacacgtacatacatacgtttaaaatgaa

SEQ ID NO: 40289 - DNA, 71 bp, chicken (Gallus Gallus)
  misc_feature (36): n=a or g
acgtgttgctggttcatccagcccagccccaacccnttcccacagctgtccaaatcaacaggacaattcca

SEQ ID NO: 40290 - DNA, 71 bp, chicken (Gallus Gallus)
  misc_feature (36): n=c or t
cgacatccaaagcgcagtcggggccaatcagaacangtatggagaggtaagagtgtccgtgtcctcctctg

SEQ ID NO: 40291 - DNA, 71 bp, chicken (Gallus Gallus)
  misc_feature (36): n=c or t
cagaacagctctgcagacctctggatcttgggagangtcttcatcagagtgtactacagcatcttcgaccg

SEQ ID NO: 40292 - DNA, 71 bp, chicken (Gallus Gallus)
  misc_feature (36): n=c or t
cctgtgggtattgcagctttgcaaggatggttttanatgtactgggtactcttcattcttgcacttctccc

SEQ ID NO: 40293 - DNA, 71 bp, chicken (Gallus Gallus)
  misc_feature (36): n=a or g
aggtcatgctgtgggtaggatgcactgtagagaccnggttgtcaccatggcaagacatacatttccccaat

SEQ ID NO: 40294 - DNA, 71 bp, chicken (Gallus Gallus)
  misc_feature (36): n=c or t
tttctgcgtggctgtcctggtgtgatggttatctangaagcacacagggctatattcggagtcgtggcaat

SEQ ID NO: 40295 - DNA, 71 bp, chicken (Gallus Gallus)
  misc_feature (36): n=g or t
atgcaggcttcgtggtcatgcagcagccgtcacctnctccctccatacacggctgtagcactttcttaagg

SEQ ID NO: 40296 - DNA, 71 bp, chicken (Gallus Gallus)
  misc_feature (36): n=a or c
taatccatcttttgtgccaggatgggccataccagnagggcccatatttccacttcaaacctttctctctc

SEQ ID NO: 40297 - DNA, 71 bp, chicken (Gallus Gallus)
  misc_feature (36): n=a or c
ttcttgaaggagctgtaggacatgtctttgaagaangtccgcagccgcacatcttccttcacctgttggag

SEQ ID NO: 40298 - DNA, 71 bp, chicken (Gallus Gallus)
  misc_feature (36): n=a or c
atcagcaaaactgaccctttcctggggcagggagtnaagatcggagctcccaaaccaaccccagtgcctca

SEQ ID NO: 40299 - DNA, 71 bp, chicken (Gallus Gallus)
  misc_feature (36): n=c or t
aaagtgcctttcaggtacttctctgtgtgtggggtncctttgttagaagaatcacgaacttccttgctgaa

SEQ ID NO: 40300 - DNA, 71 bp, chicken (Gallus Gallus)
  misc_feature (36): n=a or g
ggggattaaaacatgagttgaacagcagttcgttgngctcacagatttaactttccattcagagatttcaa

SEQ ID NO: 40301 - DNA, 71 bp, chicken (Gallus Gallus)
  misc_feature (36): n=c or t
tttgtccttaggtcactatgcaagttggtagtcagngccctctgtcctggatttatcctcgttcctcttaa

SEQ ID NO: 40302 - DNA, 71 bp, chicken (Gallus Gallus)
  misc_feature (36): n=c or t
gtgtacagcctggggcaagcctctgaagacctgttntgactgctctttagtccttccacaggaagtattca

SEQ ID NO: 40303 - DNA, 71 bp, chicken (Gallus Gallus)
  misc_feature (36): n=a or g
tctcgttttgttgcagttcttgaaaccagggtgagntagctatggtgggtaaatgtcaccattaggcatac

SEQ ID NO: 40304 - DNA, 71 bp, chicken (Gallus Gallus)
  misc_feature (36): n=c or t
acggcgtgggaactcctcgagtgagaagaggtgtcntctttgcaaattctgtttgtagagccgtgtgtttt

SEQ ID NO: 40305 - DNA, 71 bp, chicken (Gallus Gallus)
  misc_feature (36): n=a or g
agttagatacagatcctggttgacgtatatatgtgngtccaggaggaaaaataattgggtatgctggtgca

SEQ ID NO: 40306 - DNA, 71 bp, chicken (Gallus Gallus)
  misc_feature (36): n=c or t
ctctcctctcccagcaggtccctgtggggctgactnggcactgtggcacggtaacctgtcctctgcgccag

SEQ ID NO: 40307 - DNA, 71 bp, chicken (Gallus Gallus)
  misc_feature (36): n=a or g
accaatccacctttatctacttacagcagagctganctcaaggaaacaggcagtgtccggaaggctgagct

SEQ ID NO: 40308 - DNA, 71 bp, chicken (Gallus Gallus)
  misc_feature (36): n=c or t
aggatcagcttttgggttggatgggacccacggagngcagctcctggtggagatgatagaattacagaata

SEQ ID NO: 40309 - DNA, 71 bp, chicken (Gallus Gallus)
  misc_feature (36): n=a or g
ctccgcagcgatcccgaggcggcatccacctcgtcnaagtaagtcggctgcctaccagggagccagactgg

SEQ ID NO: 40310 - DNA, 71 bp, chicken (Gallus Gallus)
  misc_feature (36): n=g or t
cagcttgttgtgcaactcctggaactcctcaaaggngcgctgcacaaaggtcacctcgctcgggctctccc

SEQ ID NO: 40311 - DNA, 71 bp, chicken (Gallus Gallus)
  misc_feature (36): n=a or c
ggcaaagcaccgtccttttgtttggtgcaaatcccntttttccagcagcggctgcttctagttaagcctca

SEQ ID NO: 40312 - DNA, 71 bp, chicken (Gallus Gallus)
  misc_feature (36): n=a or g
cgcttttttctctctaagctctctcatagctcacanttatctgtcactttggtacctttggcagcacggtc

SEQ ID NO: 40313 - DNA, 71 bp, chicken (Gallus Gallus)
  misc_feature (36): n=a or g
cagagatttatgagtattttaaagggaatagaaggngagaaagcagataaattggcccatagaagaaaatg

SEQ ID NO: 40314 - DNA, 71 bp, chicken (Gallus Gallus)
  misc_feature (36): n=c or t
ttctgtctctgatttgacaggataatgctgtttgcnactgtgattatattcaccttctccctttccacagc

SEQ ID NO: 40315 - DNA, 71 bp, chicken (Gallus Gallus)
  misc_feature (36): n=a or c
aggtaaagtgaaagtccttttgcacccagactaganataagtcctctcagacttctaatctgtagctatct

SEQ ID NO: 40316 - DNA, 71 bp, chicken (Gallus Gallus)
  misc_feature (36): n=c or t
gctgctttatgcactgcattcaagagaagccctccntgagaaggaacgatggcatctctcctctgggagtc

SEQ ID NO: 40317 - DNA, 71 bp, chicken (Gallus Gallus)
  misc_feature (36): n=a or g
aaagccctgtgtgtgaggtgatgctccaatggcccnggttgttgtatagcaaaaggatccgaatttacagc

SEQ ID NO: 40318 - DNA, 71 bp, chicken (Gallus Gallus)
  misc_feature (36): n=a or g
tctacagacattttgtctacttatggcctgctccanttgccaaatcttgctctcctgccagcctgagggct

SEQ ID NO: 40319 - DNA, 71 bp, chicken (Gallus Gallus)
  misc_feature (36): n=c or t
tgagcacagctccagtggaagaggaaaaacactccngctaagttatgcaaaatatgcaaattgctttcttt

SEQ ID NO: 40320 - DNA, 71 bp, chicken (Gallus Gallus)
  misc_feature (36): n=a or c
ttataagattttaccaaccctggatgctaggtgagntctcgtctcggtataatccaaaatactaactcctc

SEQ ID NO: 40321 - DNA, 71 bp, chicken (Gallus Gallus)
  misc_feature (36): n=a or g
cccagtcctgcagcacaacagctgagtgggaccagncaaatcccacacctttgttataagcactcaaacac

SEQ ID NO: 40322 - DNA, 71 bp, chicken (Gallus Gallus)
  misc_feature (36): n=c or t
gatggcaccttgatcctccagaacataagcaaatcngatgagggaaagtatacctgctttgctgagaattt

SEQ ID NO: 40323 - DNA, 71 bp, chicken (Gallus Gallus)
  misc_feature (36): n=c or t
atcgcacttcttggaatttgactcaggctgctccanagccaggattaaaggattcagctcctgaattttat

SEQ ID NO: 40324 - DNA, 71 bp, chicken (Gallus Gallus)
  misc_feature (36): n=c or t
ggtgggttgcacgtggagatccctgcacagctctcnggatctacatggctctggggagctgctgtatcgct

SEQ ID NO: 40325 - DNA, 71 bp, chicken (Gallus Gallus)
  misc_feature (36): n=a or g
tggctgacatcatacagtgacagagaaggctctganaggagcagccctggcaaacccctcgggtctgtgat

SEQ ID NO: 40326 - DNA, 71 bp, chicken (Gallus Gallus)
  misc_feature (36): n=a or g
ggaggcgatgggggggtggaaggaacttgcagaacnggagaaaccgaggatacaggtggagttggggtaaa

SEQ ID NO: 40327 - DNA, 71 bp, chicken (Gallus Gallus)
  misc_feature (36): n=a or c
caacacacaatcaagaggcagtttcattagcgcggngcttgaaatatcccattaccaacaaacctgtcacg

SEQ ID NO: 40328 - DNA, 71 bp, chicken (Gallus Gallus)
  misc_feature (36): n=a or g
tggccttccttaacagcacagggtgagcccagcagnaggaacaaggtgaaaatccaggttcacagtcctat

SEQ ID NO: 40329 - DNA, 71 bp, chicken (Gallus Gallus)
  misc_feature (36): n=g or t
cactttttgccctctggcctcagtttccccaagctnctacaacacagacagtgtttggacacaatgccaag

SEQ ID NO: 40330 - DNA, 71 bp, chicken (Gallus Gallus)
  misc_feature (36): n=a or g
ttttacaagagaaagggccaaaatcaccaggcacanaaggatctgcagtccaaaacctgaactgaaaacaa

SEQ ID NO: 40331 - DNA, 71 bp, chicken (Gallus Gallus)
  misc_feature (36): n=a or g
aggttaaagatgtgactagaagcaacataattaatntgcaaagccataaatgaaccactgtagcctaagga

SEQ ID NO: 40332 - DNA, 71 bp, chicken (Gallus Gallus)
  misc_feature (36): n=c or t
ctctcatagcagagcaattcagtagcaaaggcatgngtgtccacgtgcacacacgtgtgtacagccaaggt

SEQ ID NO: 40333 - DNA, 71 bp, chicken (Gallus Gallus)
  misc_feature (36): n=a or c
ttacagttctgtgtgacattgaactacatcaaaatnaaaaatcactgagagcagtttattggaacatcttg

SEQ ID NO: 40334 - DNA, 71 bp, chicken (Gallus Gallus)
  misc_feature (36): n=a or g
tggttttccaattaggacagactgctcaggagaacnaaccagatctacgtggtaaggcttcttcactgccc

SEQ ID NO: 40335 - DNA, 71 bp, chicken (Gallus Gallus)
  misc_feature (36): n=g or t
aatgtgaagggtgtagaggtgtgatggatggagttnaaatgcaaggtttgagtggattcttacccgttcct

SEQ ID NO: 40336 - DNA, 71 bp, chicken (Gallus Gallus)
  misc_feature (36): n=a or g
aatgctcttaaacaaatcaccacagagagggcagantgatgcaaacgtgctgtgcgtcaccgagcttcaag

SEQ ID NO: 40337 - DNA, 71 bp, chicken (Gallus Gallus)
  misc_feature (36): n=c or t
tgccttgcatgtgaatgatatgcaagacaatgatangaatcaacttgctgaatgaatggaggcacatccca

SEQ ID NO: 40338 - DNA, 71 bp, chicken (Gallus Gallus)
  misc_feature (36): n=a or c
tgcaatgtacccaaatactgtagtgttcctagctgnctataatgactgggataaggtgtgcagtgaagtat

SEQ ID NO: 40339 - DNA, 71 bp, chicken (Gallus Gallus)
  misc_feature (36): n=c or t
gtgccagccacatgcattccacttgcagcactgaangtgcattttctgggttatttatggcacgctgagct

SEQ ID NO: 40340 - DNA, 71 bp, chicken (Gallus Gallus)
  misc_feature (36): n=c or t
gccaagagcccagctggagactggcagaacctgaangtgggttttgttccagttcttagaatcaaaggtta

SEQ ID NO: 40341 - DNA, 71 bp, chicken (Gallus Gallus)
  misc_feature (36): n=a or c
tttttttttccaaatgtattagaaatggagtaaganctggagaacctaccccataaggagggtgatgattt

SEQ ID NO: 40342 - DNA, 71 bp, chicken (Gallus Gallus)
  misc_feature (36): n=a or g
tatttttctgtttgtaggaagagtgacagcactccncatactgccaaatatacgagctgtaaagcatgaat

SEQ ID NO: 40343 - DNA, 71 bp, chicken (Gallus Gallus)
  misc_feature (36): n=a or g
ctgcagctcagcgtcctccttcccacccaggggctntgaaatgaacctgatcagaagctttgctaatgaag

SEQ ID NO: 40344 - DNA, 71 bp, chicken (Gallus Gallus)
  misc_feature (36): n=c or t
acaagctttggaaaatgattccctgaaagcgcatgnattcgatctcacttaaactcctactgcagcataac

SEQ ID NO: 40345 - DNA, 71 bp, chicken (Gallus Gallus)
  misc_feature (36): n=g or t
ttgcaccccccatgtcctcttttaaaccaaaggtgnctcagtactgggtgaaggaacgtggttaatgggca

SEQ ID NO: 40346 - DNA, 71 bp, chicken (Gallus Gallus)
  misc_feature (36): n=a or g
ttcagcacaaggagttaacatccgcagtcagactgnagagatgaagatgtagggatgtacgtgatgtaggg

SEQ ID NO: 40347 - DNA, 71 bp, chicken (Gallus Gallus)
  misc_feature (36): n=a or g
tacacgttgggtagagacatgagaattgccttttcnctttaaagtcaatttagcactatgaaaattcatga

SEQ ID NO: 40348 - DNA, 71 bp, chicken (Gallus Gallus)
  misc_feature (36): n=a or c
caatggtcatcgcccttctatttcactagctctctnatacagaaggaagacggggttttcaggatctgatt

SEQ ID NO: 40349 - DNA, 71 bp, chicken (Gallus Gallus)
  misc_feature (36): n=c or t
tcgcagctcagagacagaaacgtactcataaacagngattgctccatcccagcagtgcatgcgattgcaca

SEQ ID NO: 40350 - DNA, 71 bp, chicken (Gallus Gallus)
  misc_feature (36): n=c or t
ctcaagttgatgtagcaccagagacaagaaaaaccntcaagttactcttctgagcagctaaaaagaaattc

SEQ ID NO: 40351 - DNA, 71 bp, chicken (Gallus Gallus)
  misc_feature (36): n=a or g
ggatgcccagggaaacagacagcgagggaaagctanagttgccaacccatttagtagttatttctgagatg

SEQ ID NO: 40352 - DNA, 71 bp, chicken (Gallus Gallus)
  misc_feature (36): n=a or g
gtgttaactgggaacggtgagccccagccaagcccnagctggaaaagctgcacaggagataaagccaccag

SEQ ID NO: 40353 - DNA, 71 bp, chicken (Gallus Gallus)
  misc_feature (36): n=a or g
taataggcacagagacgtgtttaaagtcaagcttanaggataaagtggtgaccacgttacaagagtgggga

SEQ ID NO: 40354 - DNA, 71 bp, chicken (Gallus Gallus)
  misc_feature (36): n=g or t
atttaccattgtgccaagcatttgtcaagtgggttnaagtgctttttctgtttcatacgtctcataaacac

SEQ ID NO: 40355 - DNA, 71 bp, chicken (Gallus Gallus)
  misc_feature (36): n=c or t
gcccctacaggtggctttgtcagctctccaaattgngtgtgacgaggcaggttcccaattgatctctcaat

SEQ ID NO: 40356 - DNA, 71 bp, chicken (Gallus Gallus)
  misc_feature (36): n=a or g
gtgtacgggcttacagcttgactaaattggagctcnccattaaaaagtccacagtatggaacaatctattc

SEQ ID NO: 40357 - DNA, 71 bp, chicken (Gallus Gallus)
  misc_feature (36): n=a or g
taaaaacagcacccacagctactattccttgcatcntaaagctattgcatgtggggtgggttttttttatg

SEQ ID NO: 40358 - DNA, 71 bp, chicken (Gallus Gallus)
  misc_feature (36): n=a or g
cagagcatgagtactttggagccagcctgtaacaangatgcatggtgttgcaactatgcttcagaaattga

SEQ ID NO: 40359 - DNA, 71 bp, chicken (Gallus Gallus)
  misc_feature (36): n=a or g
gcaccctaggtcaggcacattagacaaagcagactnccttaatgctagcagtgtttgtgctctgccctgtt

SEQ ID NO: 40360 - DNA, 71 bp, chicken (Gallus Gallus)
  misc_feature (36): n=a or g
cgggacttggagtcagctttcctcctccgttaatcngtatttgtgctggttttaatgagttttgattgcag

SEQ ID NO: 40361 - DNA, 71 bp, chicken (Gallus Gallus)
  misc_feature (36): n=c or t
ttagtgagctggtattccaagatgatatcccgtaangaagcataatgatttcatagcgtctgcccgcgtga

SEQ ID NO: 40362 - DNA, 71 bp, chicken (Gallus Gallus)
  misc_feature (36): n=a or g
gtcaccaactcaacgctattatattaagtgcatcantacaagggaaagtgtggttccattggacatatatt

SEQ ID NO: 40363 - DNA, 71 bp, chicken (Gallus Gallus)
  misc_feature (36): n=a or g
tggggaaataacaccgagcagtagagttaaatcacntcatgttcctggaggaatttcattctggttttgag

SEQ ID NO: 40364 - DNA, 71 bp, chicken (Gallus Gallus)
  misc_feature (36): n=a or g
ttaatgctttgctctcagagctctgtactagagacngttgaccttcttaacagcctcctgtagcaaacaga

SEQ ID NO: 40365 - DNA, 71 bp, chicken (Gallus Gallus)
  misc_feature (36): n=c or t
attataaagagcatttaagccttctttaaaggaggnctcattcggttgcagggttaaaactggcatacaga

SEQ ID NO: 40366 - DNA, 71 bp, chicken (Gallus Gallus)
  misc_feature (36): n=g or t
ccttctgcaaggcagtagaagacttatttagtaggngggaagcgtcctgaaaattggttgtctgtcagggc

SEQ ID NO: 40367 - DNA, 71 bp, chicken (Gallus Gallus)
  misc_feature (36): n=a or g
attcattgcttgttcttatcagtcagtggtaaattngatggaagacaatgaaacatcttgctggtgtaaag

SEQ ID NO: 40368 - DNA, 71 bp, chicken (Gallus Gallus)
  misc_feature (36): n=c or t
gactgtgagacagaatgaccccagcaaacactgcanccagataagcacagctgtgctgcccaacacagcac

SEQ ID NO: 40369 - DNA, 71 bp, chicken (Gallus Gallus)
  misc_feature (36): n=a or g
ggctgccatatctcaagatacaacgcataccttcantctgaaatacgtctatgtaaaccgtggcatatatc

SEQ ID NO: 40370 - DNA, 71 bp, chicken (Gallus Gallus)
  misc_feature (36): n=c or t
attcacatcctgcacataaggtgcaagtatttcacnatcagatggcttcattgcaaagtcacctttccaca

SEQ ID NO: 40371 - DNA, 71 bp, chicken (Gallus Gallus)
  misc_feature (36): n=c or t
aacactgattgttccaagtcattttggtttcccagncacattaatgttgacaataaaagttatttttaaca

SEQ ID NO: 40372 - DNA, 71 bp, chicken (Gallus Gallus)
  misc_feature (36): n=c or t
ctttttgaaagggcttttcactgctacaccaagcancacaacttgtgatgccattcatcctgatatgacca

SEQ ID NO: 40373 - DNA, 71 bp, chicken (Gallus Gallus)
  misc_feature (36): n=a or c
ctaacgtcattatgggtcataaaattccttaagccncagctagaccagggaacttttccacttaaacacaa

SEQ ID NO: 40374 - DNA, 71 bp, chicken (Gallus Gallus)
  misc_feature (36): n=c or t
tctctgtacattgagaatgcctgctttcacctgatntgctggtaaacatttcatgtgctgttcaactgata

SEQ ID NO: 40375 - DNA, 71 bp, chicken (Gallus Gallus)
  misc_feature (36): n=a or c
gtggtatgaactgagtaagactcagagccatggccnaattcacaggagaatgaagcacccaaacaactgtt

SEQ ID NO: 40376 - DNA, 71 bp, chicken (Gallus Gallus)
  misc_feature (36): n=c or t
cagcctcagctgggagagacacccacaacgtcaccntcacggggctgctgccaggaagcaagtactccctg

SEQ ID NO: 40377 - DNA, 71 bp, chicken (Gallus Gallus)
  misc_feature (36): n=a or g
caagtgttttgggcagtgcagattggtcagactagntcagcatgacagaatatctcgcatcagttgcagct

SEQ ID NO: 40378 - DNA, 71 bp, chicken (Gallus Gallus)
  misc_feature (36): n=a or g
tccctgcgtattacccatcttctgcttacatctccncagagcacaggagagcgcctgctgtcccactaact

SEQ ID NO: 40379 - DNA, 71 bp, chicken (Gallus Gallus)
  misc_feature (36): n=a or g
gcctgtttggtgtctactgtccttgtgggcaaatcncacttattccccaccagcaccattggcacatcgtc

SEQ ID NO: 40380 - DNA, 71 bp, chicken (Gallus Gallus)
  misc_feature (36): n=a or g
taaaaatgcaacagaaaaagttagtacacctacacntctcagcactcaaagccttactgagcatttgggtt

SEQ ID NO: 40381 - DNA, 71 bp, chicken (Gallus Gallus)
  misc_feature (36): n=c or t
actgagtcctcaacacaccgcagcttacagggattntggaggctcttttccctttgttacaattactcaac

SEQ ID NO: 40382 - DNA, 71 bp, chicken (Gallus Gallus)
  misc_feature (36): n=c or t
gggactgtaattaacctaaggaatcctttgtctaangcaataccttcagattcacttttttaaaacatttt

SEQ ID NO: 40383 - DNA, 71 bp, chicken (Gallus Gallus)
  misc_feature (36): n=c or t
tggtgtattgaatcctttacaactgtgaataagcangcaatagctactaagttcataactgtcattagaaa

SEQ ID NO: 40384 - DNA, 71 bp, chicken (Gallus Gallus)
  misc_feature (36): n=a or g
gtagcagagacaaaacacctgtgcttggctttcctncagactgctcaccccacactgtaggtagaactgca

SEQ ID NO: 40385 - DNA, 71 bp, chicken (Gallus Gallus)
  misc_feature (36): n=a or g
gcacagagagaaactgatatccgatgtcaacacaanataactgaaatggtggcacttatggaaaaacacaa

SEQ ID NO: 40386 - DNA, 71 bp, chicken (Gallus Gallus)
  misc_feature (36): n=c or t
aacaggggctgaaaaagtagagattacttctactangtgaccgtcagaactgttcttgtcaaatcctgagg

SEQ ID NO: 40387 - DNA, 71 bp, chicken (Gallus Gallus)
  misc_feature (36): n=a or g
tttgagtaactgccagtccagccaatgcatcagggngtaaaggcaatgaagtactgctgtggcagccagct

SEQ ID NO: 40388 - DNA, 71 bp, chicken (Gallus Gallus)
  misc_feature (36): n=a or g
gcagcattctgtggtttcctttggatgctgtttttngtagaggagaaatatttgatgagagtatacctttg

SEQ ID NO: 40389 - DNA, 71 bp, chicken (Gallus Gallus)
  misc_feature (36): n=a or g
ttttttgtaaaaagtggaaatagatggaataagaanagggatagcagtcacatacccaatgctaccagaaa

SEQ ID NO: 40390 - DNA, 71 bp, chicken (Gallus Gallus)
  misc_feature (36): n=c or t
gagcagggggacaagggaacagcagcattagcaccnacactataggatcaggccaatttgttatccccagc

SEQ ID NO: 40391 - DNA, 71 bp, chicken (Gallus Gallus)
  misc_feature (36): n=c or t
aaggagaatcctggtagggctccaagcgtctgtaangtggcttgacaaatgccatgcatttccgggtagtc

SEQ ID NO: 40392 - DNA, 71 bp, chicken (Gallus Gallus)
  misc_feature (36): n=c or t
agggagcatgcaggcagcatccacaaagctgacctngggatgcagaacccacacggccctccctgtgctga

SEQ ID NO: 40393 - DNA, 71 bp, chicken (Gallus Gallus)
  misc_feature (36): n=a or g
tctccggccaccacggggtttttttgctgggggatntgagtcatccttgcaccagggaggcagcatgtgcc

SEQ ID NO: 40394 - DNA, 71 bp, chicken (Gallus Gallus)
  misc_feature (36): n=c or t
tgtgcatatttgcacaatgatggagccagaaggganttctgaggctgtgcaagagactgctgcaaagtaat

SEQ ID NO: 40395 - DNA, 71 bp, chicken (Gallus Gallus)
  misc_feature (36): n=c or t
tgggaccgcctgaaaaaacagatctctgctagtccnccagactacactcaggcaatccaactgctgcagga

SEQ ID NO: 40396 - DNA, 71 bp, chicken (Gallus Gallus)
  misc_feature (36): n=c or t
gcagtttgtctcagactagaaaacgtgacatcgctnggcctcggaagtctcagctctcctttgctagaaat

SEQ ID NO: 40397 - DNA, 71 bp, chicken (Gallus Gallus)
  misc_feature (36): n=c or t
gctttaaaaaccgctccaaatgaaggcaaaatgaanggggctgtttggagaggggagtggaggggttaact

SEQ ID NO: 40398 - DNA, 71 bp, chicken (Gallus Gallus)
  misc_feature (36): n=a or c
ctgctctgcatcctgaacccaaactcagggcaagcngctctattccccacaccccaacctcctctacttac

SEQ ID NO: 40399 - DNA, 71 bp, chicken (Gallus Gallus)
  misc_feature (36): n=c or t
aacaaaaaatccacaccacaacataaaattaatccntgccacctttttggaaatcagatctagcatgccta

SEQ ID NO: 40400 - DNA, 71 bp, chicken (Gallus Gallus)
  misc_feature (36): n=a or c
aaaaagcagtcaggaagcaaagagcccggtttgaancggagcctggagcagtgctttcaccatgccagaac

SEQ ID NO: 40401 - DNA, 71 bp, chicken (Gallus Gallus)
  misc_feature (36): n=a or g
atcataagtgctgatgtcatgcctctttgtagttcnagagctaaaagcaaaagggggggcaaaacaggcag

SEQ ID NO: 40402 - DNA, 71 bp, chicken (Gallus Gallus)
  misc_feature (36): n=c or t
ttcagaagcacagtatgaaagcaggagactacttcntaggtgtggaggggttctcagtatacatttatcta

SEQ ID NO: 40403 - DNA, 71 bp, chicken (Gallus Gallus)
  misc_feature (36): n=a or g
aaaagcagcaggaaaggcaccaaaccaacagggacnctgtgcagaccaagtggaaacagaagtcacgcagc

SEQ ID NO: 40404 - DNA, 71 bp, chicken (Gallus Gallus)
  misc_feature (36): n=c or t
cggatccaccagagccagacaagtttaacaaggtangctttccttcaagtcagctgaccacaaactccact

SEQ ID NO: 40405 - DNA, 71 bp, chicken (Gallus Gallus)
  misc_feature (36): n=g or t
tgagtcaaagcagaggctaagaacagcgccttgacnctcccaagtcattccagagctgtacttaatgattt

SEQ ID NO: 40406 - DNA, 71 bp, chicken (Gallus Gallus)
  misc_feature (36): n=c or t
cagatctgcttatctgattatgttgtagctcagtgngcctgtggggctttatgcagtttaaatagaagtac

SEQ ID NO: 40407 - DNA, 71 bp, chicken (Gallus Gallus)
  misc_feature (36): n=c or t
taaggaaggacatgaagaactctgctgtgtaactanggaccagcatctgaaggaagccgttctggacagcg

SEQ ID NO: 40408 - DNA, 71 bp, chicken (Gallus Gallus)
  misc_feature (36): n=c or t
gtctcctccgtatcctaaagaactgtgcactcaagngatgcagctatgcttagaaccagctgagatcaaac

SEQ ID NO: 40409 - DNA, 71 bp, chicken (Gallus Gallus)
  misc_feature (36): n=a or g
ggtgaattcagtgcgttgctgcccgacaatttcaangcagcaatggtacctacaagcaacgttctgtcttt

SEQ ID NO: 40410 - DNA, 71 bp, chicken (Gallus Gallus)
  misc_feature (36): n=c or t
gagaggactcccagttttaatcctcgctccagcacngatcccatgcaatgctgggctggtcgctatgatct

SEQ ID NO: 40411 - DNA, 71 bp, chicken (Gallus Gallus)
  misc_feature (36): n=a or g
cagactgaaaagaactcagattcagaagacagcttngaggaagagaatccccagcacgaacagaggaaact

SEQ ID NO: 40412 - DNA, 71 bp, chicken (Gallus Gallus)
  misc_feature (36): n=a or g
ttgagaatatgagtaatgctacctgcgctacatgcnttgctctgcaccgtgacactgttagttgtggtgtg

SEQ ID NO: 40413 - DNA, 71 bp, chicken (Gallus Gallus)
  misc_feature (36): n=a or g
tcagtctggagaatgggtgagtagtcaggctgagcnttttgcagctgtgacctctggaagcggccctcaag

SEQ ID NO: 40414 - DNA, 71 bp, chicken (Gallus Gallus)
  misc_feature (36): n=a or g
tgttcacttgacaaattgaatacaccttcaagtcantgaagagatagatcccttgaaatcttgaaacactg

SEQ ID NO: 40415 - DNA, 71 bp, chicken (Gallus Gallus)
  misc_feature (36): n=c or t
ctatgattgattccttttatggggcttattagttcnagcattctaggctccttcagtccttaactgataaa

SEQ ID NO: 40416 - DNA, 71 bp, chicken (Gallus Gallus)
  misc_feature (36): n=c or t
ggggttttggcagtaatgtggcctttgatttttttnaccaggtctctctctatggaaaattctttgccctt

SEQ ID NO: 40417 - DNA, 71 bp, chicken (Gallus Gallus)
  misc_feature (36): n=c or t
aaaattctttgcccttcctactgaaattagggtgangtgagtgccaggaggttgggtgtatcaacaggctc

SEQ ID NO: 40418 - DNA, 71 bp, chicken (Gallus Gallus)
  misc_feature (36): n=a or g
catgcagcagggttgttagggagctgcagcagaacntgcaggaaataatgtttcctttgagatttttcctg

SEQ ID NO: 40419 - DNA, 71 bp, chicken (Gallus Gallus)
  misc_feature (36): n=a or g
gatgatggtgcagagctgcggatgctttgagagtcngggctgcaacctttgctgtgacagtgggagagcgt

SEQ ID NO: 40420 - DNA, 71 bp, chicken (Gallus Gallus)
  misc_feature (36): n=c or t
cagtgaggcagggaaatgcttttccctttaatctcnttcacttatcgaaatgtccggtgctgcagatagga

SEQ ID NO: 40421 - DNA, 71 bp, chicken (Gallus Gallus)
  misc_feature (36): n=a or g
ggatgtgctctgaaacagaatgccccaaatgctccnaaacctctctgataccccaaagccaccccaaagtg

SEQ ID NO: 40422 - DNA, 71 bp, chicken (Gallus Gallus)
  misc_feature (36): n=a or g
cgttctgatctacagaaaaacggcatccccggagcntcacgtgggggctgctgcatggcttaacccttcac

SEQ ID NO: 40423 - DNA, 71 bp, chicken (Gallus Gallus)
  misc_feature (36): n=c or t
gctccgacacctgcttttgggcaacactgtcatctntgtgtgcaatgagctggcagttctcagcacagttt

SEQ ID NO: 40424 - DNA, 71 bp, chicken (Gallus Gallus)
  misc_feature (36): n=a or g
atgcttatcgaagtaatgcagtgttgagaacaaatngttggctctgctgtcagtggtcttagcactgagtg

SEQ ID NO: 40425 - DNA, 71 bp, chicken (Gallus Gallus)
  misc_feature (36): n=a or g
aagagcagtgatggctgttcctcctctttgtaacanttctgcatgcacccttttatctcagcatttggttg

SEQ ID NO: 40426 - DNA, 71 bp, chicken (Gallus Gallus)
  misc_feature (36): n=g or t
acagttatgactggcctgcaacctaattggactggnatgctggaaagtttctggagcaagttgctttggct

SEQ ID NO: 40427 - DNA, 71 bp, chicken (Gallus Gallus)
  misc_feature (36): n=a or g
accagagccaatgcacttttcaaggaatgctggaanatgtccacccaggaggggctctgtcctcatcactg

SEQ ID NO: 40428 - DNA, 71 bp, chicken (Gallus Gallus)
  misc_feature (36): n=a or g
gcagttcccaattctggcattgaatcacttcctccngtcttgtcagaatcaaatcctggtgtcggggacgt

SEQ ID NO: 40429 - DNA, 71 bp, chicken (Gallus Gallus)
  misc_feature (36): n=a or g
ttgcaaagtacgaggccatgaatatttgatgcctgnggagggtatttctttcaggaggatgttgcatgaat

SEQ ID NO: 40430 - DNA, 71 bp, chicken (Gallus Gallus)
  misc_feature (36): n=c or t
gctccgtggtgggtggtttttgggtacctgcccccngtttccagctggggacccagtagggttgaggtctg

SEQ ID NO: 40431 - DNA, 71 bp, chicken (Gallus Gallus)
  misc_feature (36): n=g or t
ctataaataggaacagtgttaattctgtctctcgcncacgccgtggcgctgggaaccggctgtgcttttaa

SEQ ID NO: 40432 - DNA, 71 bp, chicken (Gallus Gallus)
  misc_feature (36): n=g or t
tgctaattgctttgacctttgcttgagcagggatcntctagtggcaggtgaatatcagctgtgtcatttgc

SEQ ID NO: 40433 - DNA, 71 bp, chicken (Gallus Gallus)
  misc_feature (36): n=c or t
gcagcctgcacggtggggtgaaagctgggggtgttngtatgggcattgccctgcagtggtgctggtgttgc

SEQ ID NO: 40434 - DNA, 71 bp, chicken (Gallus Gallus)
  misc_feature (36): n=c or t
tgtgtgcatatagggagaaggtggaacaaacaaacnggtgcatgtgacagcaataggttttattctgggga

SEQ ID NO: 40435 - DNA, 71 bp, chicken (Gallus Gallus)
  misc_feature (36): n=c or t
cggagtggcaatcaaagtcaatgccatgcttattgnaaagcccttacagcgtgtctgcgcggcggttccaa

SEQ ID NO: 40436 - DNA, 71 bp, chicken (Gallus Gallus)
  misc_feature (36): n=a or g
tcgggactgcatacttttcttctgaggacaagaagntgacagtataaaaacagacccttgtcactttgtca

SEQ ID NO: 40437 - DNA, 71 bp, chicken (Gallus Gallus)
  misc_feature (36): n=a or g
gctctcagcttaaaagccaccttcaaaatttacaangccagcactgggacaggccgtggggttggatgttt

SEQ ID NO: 40438 - DNA, 71 bp, chicken (Gallus Gallus)
  misc_feature (36): n=a or g
ctcattattcttgtaggccaacctggccagaagtgnaggagaaagaaaatgctctgcattcaggagcagca

SEQ ID NO: 40439 - DNA, 71 bp, chicken (Gallus Gallus)
  misc_feature (36): n=c or t
accctcatgttccagagcatctcccacttaaaactnggtgagtttcatgcagggaggaagcagtcacagct

SEQ ID NO: 40440 - DNA, 71 bp, chicken (Gallus Gallus)
  misc_feature (36): n=a or g
ttctgttgtgcaaagcctgcagttacgagcctgaancaggtcctgaccccactcccagcatctcctccaga

SEQ ID NO: 40441 - DNA, 71 bp, chicken (Gallus Gallus)
  misc_feature (36): n=a or c
agcagccattgctgccatgtccctcgtgcccagccngacccacgcacctgggccatgtccagggtgaagtt

SEQ ID NO: 40442 - DNA, 71 bp, chicken (Gallus Gallus)
  misc_feature (36): n=g or t
tcttgtattttgataggataagagtgcaaaggtggnaacaactcctgtgagtggtactccctgcctgggta

SEQ ID NO: 40443 - DNA, 71 bp, chicken (Gallus Gallus)
  misc_feature (36): n=a or g
gagattagtctgggtgctgacagatgacatgtgttntatgtcctgtggcagtgagtttgtgttgctgtaaa

SEQ ID NO: 40444 - DNA, 71 bp, chicken (Gallus Gallus)
  misc_feature (36): n=a or g
aatcgctgcactgctttgtccatgtgtgcttcaccnaaggcagtaattgcatcaaagcaatgggtaacacc

SEQ ID NO: 40445 - DNA, 71 bp, chicken (Gallus Gallus)
  misc_feature (36): n=a or g
tgtcagttcctgtgttattaggagaggaagggtgangctttcaggaccctcaggcaatatttatgtgtttg

SEQ ID NO: 40446 - DNA, 71 bp, chicken (Gallus Gallus)
  misc_feature (36): n=c or t
tcattaaaacacgggtgcaggtgatggaagctggcngtggtttatctcagcactgagttctgggcatgctg

SEQ ID NO: 40447 - DNA, 71 bp, chicken (Gallus Gallus)
  misc_feature (36): n=a or g
tctgggagggcaggtaggtggactcaatcccaacantgcagtagtcgctgttgctctgtcaagacggaata

SEQ ID NO: 40448 - DNA, 71 bp, chicken (Gallus Gallus)
  misc_feature (36): n=c or t
ccaacacggggctccatgctgcagctatatgtgtangcatcagaacaggggactgagttagagccaagaac

SEQ ID NO: 40449 - DNA, 71 bp, chicken (Gallus Gallus)
  misc_feature (36): n=a or c
cacgtagccctcacaaagcatgcattctgccctacngaagactccagtacagatctgaacaccacaaacat

SEQ ID NO: 40450 - DNA, 71 bp, chicken (Gallus Gallus)
  misc_feature (36): n=a or g
aaagtggctcagacagagagcaaatggggctctttntggacagaggagacgtagagcggcgctgtgctcta

SEQ ID NO: 40451 - DNA, 71 bp, chicken (Gallus Gallus)
  misc_feature (36): n=c or t
ctgagcaagtaagttatactgcttcctcagatctcnaaaaagggagacaatattcaatctcatggtgttca

SEQ ID NO: 40452 - DNA, 71 bp, chicken (Gallus Gallus)
  misc_feature (36): n=c or t
tgaagcatgacttcaagcattctttccctaaaaacncaaaagctttaacttgaaaaatacaccttttaata

SEQ ID NO: 40453 - DNA, 71 bp, chicken (Gallus Gallus)
  misc_feature (36): n=c or t
aaaagcactaggaacatgcagagtaggtataccgcntctttgaacaggaaggacaagcaatgagagtgaat

SEQ ID NO: 40454 - DNA, 71 bp, chicken (Gallus Gallus)
  misc_feature (36): n=a or c
cacgacaccttcaggtactatctgtttatctaaccnccaagttcatcacagaaatagttaaagctgtgttc

SEQ ID NO: 40455 - DNA, 71 bp, chicken (Gallus Gallus)
  misc_feature (36): n=a or g
cacgttcagcatgttggaatttctcatgcacttacngtgcattttgctatttatgatgtcttatcaaccag

SEQ ID NO: 40456 - DNA, 71 bp, chicken (Gallus Gallus)
  misc_feature (36): n=c or t
tctgctgatgtcaccaggatttctctggagaggaangggacgtttgttacagacctttcgaacaatgagat

SEQ ID NO: 40457 - DNA, 71 bp, chicken (Gallus Gallus)
  misc_feature (36): n=a or g
tcttgtataccctataattggccaaggaaactggantgactccaggtcctttgggtccctttgagaagata

SEQ ID NO: 40458 - DNA, 71 bp, chicken (Gallus Gallus)
  misc_feature (36): n=c or t
gctgcttcttgcacctgcaaagctgcctgccaagangctgcagacccaactaggtgcttaaggaacatgtc

SEQ ID NO: 40459 - DNA, 71 bp, chicken (Gallus Gallus)
  misc_feature (36): n=a or g
ttaggtcaaaagaaagctcctgggagatccttgatntggaagattcatctttatggagtgcaatccccaga

SEQ ID NO: 40460 - DNA, 71 bp, chicken (Gallus Gallus)
  misc_feature (36): n=a or g
aagctagtacagctacacacccagcaggccagagangaaaggatgacaaaaaatagtgcttaagtaatcat

SEQ ID NO: 40461 - DNA, 71 bp, chicken (Gallus Gallus)
  misc_feature (36): n=c or t
gccaacaaaacagctcggcgtgagctctctgacccnacagaggatttgttcaaagccttttgttgtgtcgt

SEQ ID NO: 40462 - DNA, 71 bp, chicken (Gallus Gallus)
  misc_feature (36): n=g or t
caacacagcaggtttgggaggctgttacagagcttntgttagcaagggaagagccatgcaggctctccttc

SEQ ID NO: 40463 - DNA, 71 bp, chicken (Gallus Gallus)
  misc_feature (36): n=c or t
ttctctgagcactgcctgcagcaccgcctgccacgngagggcccactactttgccaagaaataagtgttcc

SEQ ID NO: 40464 - DNA, 71 bp, chicken (Gallus Gallus)
  misc_feature (36): n=c or t
ttgtttctatggttaatcatctctgatataatttgngtgctaagaatagactttttcatacctcagtgcca

SEQ ID NO: 40465 - DNA, 71 bp, chicken (Gallus Gallus)
  misc_feature (36): n=c or t
ggtgggcagcagctctgatgtgcgcatggaaacccngcagcgcactgacagcatgtggggagcctgccctc

SEQ ID NO: 40466 - DNA, 71 bp, chicken (Gallus Gallus)
  misc_feature (36): n=a or g
aaaaccctctgagcacatggaggtgagatggcagantccccatttctcctgagcagcagaatagctgcctt

SEQ ID NO: 40467 - DNA, 71 bp, chicken (Gallus Gallus)
  misc_feature (36): n=c or t
gatatatttgccaagcaaaccttcagaacttcattntcaggtaagatcttctcagaaagaaagtctgcctc

SEQ ID NO: 40468 - DNA, 71 bp, chicken (Gallus Gallus)
  misc_feature (36): n=c or t
agcaccgacaagggcgagtctctgggaatcaaatangaagagtgagttgaagtcttgttttgaaatcgggg

SEQ ID NO: 40469 - DNA, 71 bp, chicken (Gallus Gallus)
  misc_feature (36): n=c or t
tttcacttctctgctgctttttgtgctctccccatnctgctgtgccaacctgctctcagttctgtgctttc

SEQ ID NO: 40470 - DNA, 71 bp, chicken (Gallus Gallus)
  misc_feature (36): n=c or t
caagtttgtactgaataaattatgcctgggagtccnccaagaagactttaagaaaacggggtgttttgaac

SEQ ID NO: 40471 - DNA, 71 bp, chicken (Gallus Gallus)
  misc_feature (36): n=a or g
aggtcctgtggctgaagacaagcaatccatcagcantataactgagagccaagtacacaagctccacttac

SEQ ID NO: 40472 - DNA, 71 bp, chicken (Gallus Gallus)
  misc_feature (36): n=c or t
ctgaactcttgtcacctctcctgcaggtcaccaccntgtgtttaaagagctgcagctccaagtaaagacgc

SEQ ID NO: 40473 - DNA, 71 bp, chicken (Gallus Gallus)
  misc_feature (36): n=a or g
ttgtagatatttgtgtaacagctgtgttttcacatntgtgcatctatgtgtgtatgttcatatgtagatag

SEQ ID NO: 40474 - DNA, 71 bp, chicken (Gallus Gallus)
  misc_feature (36): n=a or g
cgtctatgttttttctactaagaagatcttcagtgntagtatctccatcctaccaatctagtaactccttt

SEQ ID NO: 40475 - DNA, 71 bp, chicken (Gallus Gallus)
  misc_feature (36): n=c or t
caagactggacaaaaacactatattgcatagatgcngctggttacaacagcttatgtctgaaatgataaaa

SEQ ID NO: 40476 - DNA, 71 bp, chicken (Gallus Gallus)
  misc_feature (36): n=c or t
ttttcttgccactgtcaggtgcagtggtgctgctangttgagtgccaacagtgcatgcaggaagaagtggt

SEQ ID NO: 40477 - DNA, 71 bp, chicken (Gallus Gallus)
  misc_feature (36): n=a or c
agcactgaaggtccaaggcttggatagaagagctgnatacctctgtcaacacacagaaaaggagaactggg

SEQ ID NO: 40478 - DNA, 71 bp, chicken (Gallus Gallus)
  misc_feature (36): n=a or g
ctcagtacagacatttaatcatacccagcaaggaangccaatagccatctaatcaccaagtgaggtatttg

SEQ ID NO: 40479 - DNA, 71 bp, chicken (Gallus Gallus)
  misc_feature (36): n=g or t
aaacattggtttccagaaacggcagcttgataaagngtcacacgtgctgtagaaccagcgctgccctcagc

SEQ ID NO: 40480 - DNA, 71 bp, chicken (Gallus Gallus)
  misc_feature (36): n=c or t
agcagagcaaacagagctgagcagcacgctgagccncactcagaacataacatccctcagcaaagcatcgc

SEQ ID NO: 40481 - DNA, 71 bp, chicken (Gallus Gallus)
  misc_feature (36): n=a or g
tcagccggagctctcgggtcccatcactacaccacntccctaagggccatgtccacatggtggggatacca

SEQ ID NO: 40482 - DNA, 71 bp, chicken (Gallus Gallus)
  misc_feature (36): n=a or g
agtctgaggggctctgagtggagtctgggcctgtanggggttggagtggagtgtgtgggattctaagggct

SEQ ID NO: 40483 - DNA, 71 bp, chicken (Gallus Gallus)
  misc_feature (36): n=a or c
agaaggctgctcagcctctggaccgatcgttcctcntttctgttctcttgaaattaacaagtgggaagtca

SEQ ID NO: 40484 - DNA, 71 bp, chicken (Gallus Gallus)
  misc_feature (36): n=a or g
tttctaattgaatcctatcggcacaccaaaatcgcnttctttaaaactcatggctgctgtatgtcaggatt

SEQ ID NO: 40485 - DNA, 71 bp, chicken (Gallus Gallus)
  misc_feature (36): n=a or g
tgtagggaatggatgtaaacatgatcttatctgcanacctctcagtgagcgctcacagggatcggggtttg

SEQ ID NO: 40486 - DNA, 71 bp, chicken (Gallus Gallus)
  misc_feature (36): n=a or g
ggagcagcctttggggagcagagaacaggaggtganaggggaccccttggcctggggggaagatgtggggt

SEQ ID NO: 40487 - DNA, 71 bp, chicken (Gallus Gallus)
  misc_feature (36): n=a or g
tgcactgccgacgttttatggagctcgggtgttgcntatcaaaaaaagaagcctacatttcttctcctacc

SEQ ID NO: 40488 - DNA, 71 bp, chicken (Gallus Gallus)
  misc_feature (36): n=a or c
tgactgccacttgccccagttcctcttgatctcagnctggacctgaagtgacaccaggattggtgctggca

SEQ ID NO: 40489 - DNA, 71 bp, chicken (Gallus Gallus)
  misc_feature (36): n=g or t
tccggtctgtgggcttgatgtaaggtgaagatttgngtttccagagcaagaaatcccagatgtccccaaga

SEQ ID NO: 40490 - DNA, 71 bp, chicken (Gallus Gallus)
  misc_feature (36): n=a or g
cctgcctggcagttccatcaccctgtgtgcatcagnggcagatgggggacatctgctttgctgtccaccag

SEQ ID NO: 40491 - DNA, 71 bp, chicken (Gallus Gallus)
  misc_feature (36): n=c or t
tcccttgcttatacccaggtgatgcagaaggacagngagaagaacatgtccatcaagaagctgtggaagta

SEQ ID NO: 40492 - DNA, 71 bp, chicken (Gallus Gallus)
  misc_feature (36): n=c or t
ctatgtcacaccgggcttgaatcacaataagtgctnccattttttcaagtcagacactcttggaagcgttg

SEQ ID NO: 40493 - DNA, 71 bp, chicken (Gallus Gallus)
  misc_feature (36): n=a or g
aggtccttccatgacacttacgaagctttgataccnttgggaaagaacccagagcatcccatcccacgaca

SEQ ID NO: 40494 - DNA, 71 bp, chicken (Gallus Gallus)
  misc_feature (36): n=c or t
taaaaataacacctcccttccagctttagataccangggataagataaaacatgagaacctggcaaatttt

SEQ ID NO: 40495 - DNA, 71 bp, chicken (Gallus Gallus)
  misc_feature (36): n=a or g
tttaaagagccaggagtgcgcaacacagtgagagcntaacccagcagtcctgatgtgagaatggtgcatct

SEQ ID NO: 40496 - DNA, 71 bp, chicken (Gallus Gallus)
  misc_feature (36): n=c or t
ccaaacccttggaaagaacaaggcctcctagaaacngcagttttctctctgtagcccgtgaacatgcatgc

SEQ ID NO: 40497 - DNA, 71 bp, chicken (Gallus Gallus)
  misc_feature (36): n=a or g
agttaagacatgataacctcggttaggatgaatagnctgagtaaacctggatagtagtttacattacagaa

SEQ ID NO: 40498 - DNA, 71 bp, chicken (Gallus Gallus)
  misc_feature (36): n=a or g
tacttctagtggtcagaaatatttctcagactggangtgcactcttcattgattcctgagaaatacacaga

SEQ ID NO: 40499 - DNA, 71 bp, chicken (Gallus Gallus)
  misc_feature (36): n=g or t
ttagaaaatggtgaaccatgggtaacacatcaagancagttagcatcttgacttccatggggccaacacaa

SEQ ID NO: 40500 - DNA, 71 bp, chicken (Gallus Gallus)
  misc_feature (36): n=c or t
tgggccccactttcaagcctcacattatagaactcntctgaaggcaccttctcctgggacacgcacagtgg

SEQ ID NO: 40501 - DNA, 71 bp, chicken (Gallus Gallus)
  misc_feature (36): n=a or g
gagaaaattcgtcaagtaatccatttcagcacatcnccactcctagcattagaaagatttcactcctgttt

SEQ ID NO: 40502 - DNA, 71 bp, chicken (Gallus Gallus)
  misc_feature (36): n=c or t
tgagacacagcttgttgtgtcataaaatatattcantgtgatttgcaaggtcttataaagccaatgacatt

SEQ ID NO: 40503 - DNA, 71 bp, chicken (Gallus Gallus)
  misc_feature (36): n=a or g
gcagtttcagctagtgcttcttactcacctattccngtaattgattgcacacctctgcagagcagcttctt

SEQ ID NO: 40504 - DNA, 71 bp, chicken (Gallus Gallus)
  misc_feature (36): n=c or t
atgtggaaaacaagagaaaaacagccctcgctcccnagttcttcagtgttcctacaactgaatttcaattt

SEQ ID NO: 40505 - DNA, 71 bp, chicken (Gallus Gallus)
  misc_feature (36): n=a or g
gcagagatagcaatcagctggtatttatttaaaccncaattaccttctcattagccctaaatggaattcct

SEQ ID NO: 40506 - DNA, 71 bp, chicken (Gallus Gallus)
  misc_feature (36): n=a or g
tcattttgcaagaactaactctcctgtacagaaccntactgagcagaagagcacccttcagccccaccaca

SEQ ID NO: 40507 - DNA, 71 bp, chicken (Gallus Gallus)
  misc_feature (36): n=c or t
cctccttcactcccaggacagatccaggtcttctgntcaggatgcccaggactgtgggttggaaaggccaa

SEQ ID NO: 40508 - DNA, 71 bp, chicken (Gallus Gallus)
  misc_feature (36): n=a or g
agtactgagtcctacttctcatggaagctttgtaancttaaaataacctggactactgaatgaattatccc

SEQ ID NO: 40509 - DNA, 71 bp, chicken (Gallus Gallus)
  misc_feature (36): n=a or g
taaatgtaaacagctacagaagcccaactgctgtcnggatcgaagctgaggaaacaaattagatggagctt

SEQ ID NO: 40510 - DNA, 71 bp, chicken (Gallus Gallus)
  misc_feature (36): n=a or c
tcaaggttgttgcaaatttcaccttgtaaacacatngttccttaaagctctgttaaatacaatgtagtatt

SEQ ID NO: 40511 - DNA, 71 bp, chicken (Gallus Gallus)
  misc_feature (36): n=c or t
aattgcttcaagagaatcaggcctaccacttgtttnagtccaatcaaattgagcttcctatggtactttat

SEQ ID NO: 40512 - DNA, 71 bp, chicken (Gallus Gallus)
  misc_feature (36): n=c or t
gtccagctagatgaactgaagtttgcttgccattanatttagtatcttaaaggtaatgcactcagcagtcc

SEQ ID NO: 40513 - DNA, 71 bp, chicken (Gallus Gallus)
  misc_feature (36): n=a or g
gcaggacctatccagaaggagcaacaacacagttgngtcagaagcacagccttggagctacttcttatgta

SEQ ID NO: 40514 - DNA, 71 bp, chicken (Gallus Gallus)
  misc_feature (36): n=a or g
agtcaccccaaacatcatccaggacaccgtgcctcnggctgtgaattcaaaactacgagttctgcataagt

SEQ ID NO: 40515 - DNA, 71 bp, chicken (Gallus Gallus)
  misc_feature (36): n=c or t
cctttctagctatcatcagtgttcattcagatttanaaatagataaatactctctactctcagcctgtttt

SEQ ID NO: 40516 - DNA, 71 bp, chicken (Gallus Gallus)
  misc_feature (36): n=c or t
gcttctattgcttttcccaacacagagagtctcagnctatcttgttcctgtgatgatttctatcactgcag

SEQ ID NO: 40517 - DNA, 71 bp, chicken (Gallus Gallus)
  misc_feature (36): n=a or g
tctggcttcaacctcggtgtctttgctggtctcctntcataggagggacagaaagttcattccagaagatg

SEQ ID NO: 40518 - DNA, 71 bp, chicken (Gallus Gallus)
  misc_feature (36): n=c or t
gagttcagctcaatataaaatggggacaaaggtttnggaaaagttgaaactgttcatcttgacacttacag

SEQ ID NO: 40519 - DNA, 71 bp, chicken (Gallus Gallus)
  misc_feature (36): n=a or g
tgggcagctgaaaggaactcaacgcgtctattttangcaacctctagtgaagccatttggcaccagcacag

SEQ ID NO: 40520 - DNA, 71 bp, chicken (Gallus Gallus)
  misc_feature (36): n=a or g
atggtgcaaatgtgattagtgcctccctcctcccantgattattacattgctgtacaaggagatgatgagc

SEQ ID NO: 40521 - DNA, 71 bp, chicken (Gallus Gallus)
  misc_feature (36): n=a or g
tccactcagccctggaggagctgaaagaggcacaantgaatggtcagtgaatcatagaaatattggtgtca

SEQ ID NO: 40522 - DNA, 71 bp, chicken (Gallus Gallus)
  misc_feature (36): n=a or g
aaagaaatctcttctttgttcttggcagccaactgnaccttatttgtcaatctgagcagtgcaactgcttt

SEQ ID NO: 40523 - DNA, 71 bp, chicken (Gallus Gallus)
  misc_feature (36): n=c or t
tacgaccttttgcatgtgaatatcatcgggggaacnacaatgtgagccattcaaaccatgccgcggtcgct

SEQ ID NO: 40524 - DNA, 71 bp, chicken (Gallus Gallus)
  misc_feature (36): n=c or t
aagtttgaacagtcattgaggaatggtgtaatttantgtagtgtgtggtacaaatgaagagtaggaatgaa

SEQ ID NO: 40525 - DNA, 71 bp, chicken (Gallus Gallus)
  misc_feature (36): n=a or g
gcagagcagggagagctctgagatagcccaaactcnaaggtagagcatatgttctattcactccattattg

SEQ ID NO: 40526 - DNA, 71 bp, chicken (Gallus Gallus)
  misc_feature (36): n=c or t
gcactgctgtgcaggaaaacaagctgggtatctcantgggaggtatttcagctctgggttgtagggcgttt

SEQ ID NO: 40527 - DNA, 71 bp, chicken (Gallus Gallus)
  misc_feature (36): n=a or g
atggaatcacattcttatttagttccaggaattaantgggttaaaaaggactcccttgagggtacccaggg

SEQ ID NO: 40528 - DNA, 71 bp, chicken (Gallus Gallus)
  misc_feature (36): n=a or c
gcctttggactgatggttcttcccaacctcacatgnatgatcccaaatggcagcaggtgtgggtgggagca

SEQ ID NO: 40529 - DNA, 71 bp, chicken (Gallus Gallus)
  misc_feature (36): n=a or c
acagcaaacccattccctcctttccaggagctctgngattgctcacggggagggatggatcagatgggaat

SEQ ID NO: 40530 - DNA, 71 bp, chicken (Gallus Gallus)
  misc_feature (36): n=c or t
atttgcacagcaggtaagtgaggaaagagattcttnatcaatctctcgctgtctctgctggtgaatctctg

SEQ ID NO: 40531 - DNA, 71 bp, chicken (Gallus Gallus)
  misc_feature (36): n=a or g
actcatctattaaagtgggacctgaaaggggatatnattatccgcttgatatacttagagagaaaacacca

SEQ ID NO: 40532 - DNA, 71 bp, chicken (Gallus Gallus)
  misc_feature (36): n=c or t
gttcccttattgctatcgtaactgcattgcaaacgncgctccatgcaaacgcagtgtttcctttgtgccct

SEQ ID NO: 40533 - DNA, 71 bp, chicken (Gallus Gallus)
  misc_feature (36): n=a or g
tttgactaatgagaactttgtcacttagctgtttcntaacctaaaactcatcttgaggtcagaaatttaat

SEQ ID NO: 40534 - DNA, 71 bp, chicken (Gallus Gallus)
  misc_feature (36): n=a or g
tttttttagctctgtagcttactgctttgaatccanccttaccgtatagaaactgagttgcttttaagctc

SEQ ID NO: 40535 - DNA, 71 bp, chicken (Gallus Gallus)
  misc_feature (36): n=a or g
atgtgtatgttcaatgcctttgttgagctgccagcngcagttgtcatgcatattggtcattgtctccccac

SEQ ID NO: 40536 - DNA, 71 bp, chicken (Gallus Gallus)
  misc_feature (36): n=c or t
ggaatagtgctgcctttgagtatttaaagtgtgcangtgaaaggatatgaatttttaagtgcttcacattt

SEQ ID NO: 40537 - DNA, 71 bp, chicken (Gallus Gallus)
  misc_feature (36): n=a or g
tcctaatagctaaaaccaaagtttaaaaccaaagcntttatgttaccagcacacatggatgtgtttacaat

SEQ ID NO: 40538 - DNA, 71 bp, chicken (Gallus Gallus)
  misc_feature (36): n=g or t
caagctctacagtggcttcttcttcatcatcttctntagtgatgatcctctgaggggactctgtgactgca

SEQ ID NO: 40539 - DNA, 71 bp, chicken (Gallus Gallus)
  misc_feature (36): n=a or c
tgaggggaactatctggggaggaaggagatcagttntacaaggaggtagatgtggttagtaactcgtgttg

SEQ ID NO: 40540 - DNA, 71 bp, chicken (Gallus Gallus)
  misc_feature (36): n=a or g
agcagctgggaagtgataggtgagttacctttgcantctgcaacttcgggctgaaattcacaggaaatatt

SEQ ID NO: 40541 - DNA, 71 bp, chicken (Gallus Gallus)
  misc_feature (36): n=a or g
ctgagtggagcagtggatccttgtgcttaaaaggantgagtactggtgctttttaatgaagcatcagaagc

SEQ ID NO: 40542 - DNA, 71 bp, chicken (Gallus Gallus)
  misc_feature (36): n=a or g
gtgatggaatgaatgggttcttttttggaagtaaantaataatggagtggtggatggtgcttggaagctgt

SEQ ID NO: 40543 - DNA, 71 bp, chicken (Gallus Gallus)
  misc_feature (36): n=a or c
ggcaccactcctcgcccagctcgggctctgtttgcngaagtctcctctgctgggctcgcaaagttcaccac

SEQ ID NO: 40544 - DNA, 71 bp, chicken (Gallus Gallus)
  misc_feature (36): n=a or g
ctccgagaggcagacagttgggattaaagcagccanagaaacagtgcagttaattaaaacaaaggacaagg

SEQ ID NO: 40545 - DNA, 71 bp, chicken (Gallus Gallus)
  misc_feature (36): n=a or g
gctttggaagtgcatccccaacacttattgcaatgnagatggtgccataaaagcagacctccaggccagca

SEQ ID NO: 40546 - DNA, 71 bp, chicken (Gallus Gallus)
  misc_feature (36): n=a or g
ctttccagctggatccttcctggctggagaactggnaaaactacagattggggacagtgcaaaattgagac

SEQ ID NO: 40547 - DNA, 71 bp, chicken (Gallus Gallus)
  misc_feature (36): n=a or g
ggtctgagaggtattttccaagcctcagtgattctnctcccaattaaaccctactgctccccactaccaac

SEQ ID NO: 40548 - DNA, 71 bp, chicken (Gallus Gallus)
  misc_feature (36): n=a or c
acttccttttaactatcaaatggttggagactccancagtgccactccaaacaggagagctggaacagcac

SEQ ID NO: 40549 - DNA, 71 bp, chicken (Gallus Gallus)
  misc_feature (36): n=a or g
tgagcagggacgggagcgcagccctgggctcgcagngagctgagagccagctgagccacattccagggcac

SEQ ID NO: 40550 - DNA, 71 bp, chicken (Gallus Gallus)
  misc_feature (36): n=a or g
tgcccagaacgctgctggggctgggaaacaatcgcntggagcatgtgtggaaacggagcctccgtgtgccc

SEQ ID NO: 40551 - DNA, 71 bp, chicken (Gallus Gallus)
  misc_feature (36): n=c or t
actccatggttctttggttccacgatcctttgattncatgattatacgatgctctggttctgtggttctgt

SEQ ID NO: 40552 - DNA, 71 bp, chicken (Gallus Gallus)
  misc_feature (36): n=a or g
ttcctatgaatgaaatacacaaacagctattaaagntgctttaaagggatacggagatgaaggggctgtat

SEQ ID NO: 40553 - DNA, 71 bp, chicken (Gallus Gallus)
  misc_feature (36): n=a or g
tcagatgcccgtgcttgtgctcttcggaagagctcnaggtcatactcgctggtcaggttctcaagcagagg

SEQ ID NO: 40554 - DNA, 71 bp, chicken (Gallus Gallus)
  misc_feature (36): n=c or t
cccttttttgagctcccccactgagactttcatcanagacatacacaaccatctgtatagtaaagccttcc

SEQ ID NO: 40555 - DNA, 71 bp, chicken (Gallus Gallus)
  misc_feature (36): n=g or t
agcagcgctataggaacccgtgggaagttgggaganggactcccacagcgtgctgctctcccaaactgttc

SEQ ID NO: 40556 - DNA, 71 bp, chicken (Gallus Gallus)
  misc_feature (36): n=a or g
gttggggaatggagaacagctcatctgcctgtaagnaagaaaggagcttctggctcttctgctggctcctg

SEQ ID NO: 40557 - DNA, 71 bp, chicken (Gallus Gallus)
  misc_feature (36): n=a or c
caccggactggtgtcataattgaaggtttctcccanggggtgatcccgtgctctgtaaaacccctccaggc

SEQ ID NO: 40558 - DNA, 71 bp, chicken (Gallus Gallus)
  misc_feature (36): n=a or g
cagaagaactttgacccagtccttccacctctgccngataactttgatgatgattttgatgaagaatcagt

SEQ ID NO: 40559 - DNA, 71 bp, chicken (Gallus Gallus)
  misc_feature (36): n=a or g
tatgctcattatatgcagtaatttgtatcatacctngcatacaatgagtgaataccttcgtttacgagtgt

SEQ ID NO: 40560 - DNA, 71 bp, chicken (Gallus Gallus)
  misc_feature (36): n=g or t
tgtgcactctcagcctgaacaggttagtaaaagacnggagtgactttttagactgcaaatagtgcgctttg

SEQ ID NO: 40561 - DNA, 71 bp, chicken (Gallus Gallus)
  misc_feature (36): n=c or t
agaaaggcagaatttctgttccagtttcacaacgtnctgtaatgacagaatatctctggatttgtcactta

SEQ ID NO: 40562 - DNA, 71 bp, chicken (Gallus Gallus)
  misc_feature (36): n=c or t
agcccagaaagtgaatacaggatctaaaagtagttntacagcattgaaaggcaaaactgatgcaggcaatg

SEQ ID NO: 40563 - DNA, 71 bp, chicken (Gallus Gallus)
  misc_feature (36): n=a or c
tgcatgatcagaagtcacatctatgtgaaatggaangaagtgttgcctgaggttcagggatgggatttaag

SEQ ID NO: 40564 - DNA, 71 bp, chicken (Gallus Gallus)
  misc_feature (36): n=c or t
ttcaatgctgtgcccctatcggctccttggggatgncatggttcctgtttcgttagcgtggtctgatgaaa

SEQ ID NO: 40565 - DNA, 71 bp, chicken (Gallus Gallus)
  misc_feature (36): n=a or g
ggaaaggagggagcatggcagggaaaagccttcggngctctgctcagggcttggagtgagcaaccagggct

SEQ ID NO: 40566 - DNA, 71 bp, chicken (Gallus Gallus)
  misc_feature (36): n=c or t
cgctcatgggcttcatccagcataataatggcatantgggtcagatcaggatctatcaagcactctctcag

SEQ ID NO: 40567 - DNA, 71 bp, chicken (Gallus Gallus)
  misc_feature (36): n=a or g
cttgtgagcaggctgaggggtcaagggttgtggatnagtatctcttttgatttgttgctcctaagaatata

SEQ ID NO: 40568 - DNA, 71 bp, chicken (Gallus Gallus)
  misc_feature (36): n=a or g
aaatagcacctctatgacccactgctttcttgttcnttcatgtgtcaataaaaaagtctccagagcttttc

SEQ ID NO: 40569 - DNA, 71 bp, chicken (Gallus Gallus)
  misc_feature (36): n=g or t
gttttggggagacagaaaataaggcaaattcagttntccaagcattatccatagctaaaaggtcaagtctg

SEQ ID NO: 40570 - DNA, 71 bp, chicken (Gallus Gallus)
  misc_feature (36): n=a or g
ttttttcataacatgcatagcaaactgtaggaaccnggaagggcaattttggcccaacaaacctattcgtt

SEQ ID NO: 40571 - DNA, 71 bp, chicken (Gallus Gallus)
  misc_feature (36): n=a or g
ggagaaatggggggaatgaacggggctgcgggcagngagcgctccgcagcacagctggcaccggagaactc

SEQ ID NO: 40572 - DNA, 71 bp, chicken (Gallus Gallus)
  misc_feature (36): n=a or g
agtttgatggtcaaccctgaatccagatgtgcttcnaatgaaccaatatctgctgggaaatggaacacttc

SEQ ID NO: 40573 - DNA, 71 bp, chicken (Gallus Gallus)
  misc_feature (36): n=a or g
gctaaaagagggctcagaagagagctggtgcccctnggagaccctttccacattgccccatttgttgctgg

SEQ ID NO: 40574 - DNA, 71 bp, chicken (Gallus Gallus)
  misc_feature (36): n=a or g
tgtgagttgcaatgtgtcggtaggcagcaatgattnccaggatgaggagcatgccagctccttgtcggctc

SEQ ID NO: 40575 - DNA, 71 bp, chicken (Gallus Gallus)
  misc_feature (36): n=a or g
ggtccccaagtgctcaacctttggagggatgctatngggcaggaataggtgataagcatcagcaagcaaaa

SEQ ID NO: 40576 - DNA, 71 bp, chicken (Gallus Gallus)
  misc_feature (36): n=a or g
gccaggatctgaaattaagaccccatgctcccctcnctaattaccttcaaaaatctcaattgcataccagg

SEQ ID NO: 40577 - DNA, 71 bp, chicken (Gallus Gallus)
  misc_feature (36): n=a or g
cggttccttgtaaatggacataatatccctggaacnaaggaagcaagaattagtcaagatctcccttggtg

SEQ ID NO: 40578 - DNA, 71 bp, chicken (Gallus Gallus)
  misc_feature (36): n=c or t
ggtgatataaacaatctgtgcttgtgcagtcactcngacactgtcacgcgtccatctcatggtgagggaac

SEQ ID NO: 40579 - DNA, 71 bp, chicken (Gallus Gallus)
  misc_feature (36): n=c or t
cattaaaactccaataacttttctatcttcttctgnctgtcatttctccaaggcatattgccagattttgc

SEQ ID NO: 40580 - DNA, 71 bp, chicken (Gallus Gallus)
  misc_feature (36): n=a or g
aaaatgaggaatctcaactgtgatcctggaagtctnggggcttggcaaggctcgttgtttatattgctcca

SEQ ID NO: 40581 - DNA, 71 bp, chicken (Gallus Gallus)
  misc_feature (36): n=c or t
aaaagcactgtcccaaattcccactgactgcgaccngagtgacgtttccacagcggggctgcccggtggat

SEQ ID NO: 40582 - DNA, 71 bp, chicken (Gallus Gallus)
  misc_feature (36): n=a or c
tttattttatacgtatatcaattatgtgtgtacatnagcgtttgtgacacgaaggagcctgacccgatggg

SEQ ID NO: 40583 - DNA, 71 bp, chicken (Gallus Gallus)
  misc_feature (36): n=a or g
tctgctctatttgtcaactatttgtaacgtcctgcnggagggatccgctccagacactgtacataggaaat

SEQ ID NO: 40584 - DNA, 71 bp, chicken (Gallus Gallus)
  misc_feature (36): n=a or c
caatcaccccatcccgttcgacggacattttaaagntcttcaagttgagggacccgaatctcagccgcagt

SEQ ID NO: 40585 - DNA, 71 bp, chicken (Gallus Gallus)
  misc_feature (36): n=a or g
gggtgaaaagtgaggttttctctcaggtttgggatngtttcccttgtaacactgaagctttttatggagga

SEQ ID NO: 40586 - DNA, 71 bp, chicken (Gallus Gallus)
  misc_feature (36): n=c or t
tcagtttcctcattagtactggaaggaaacaaaacntgtccctcagcatggaagtctggggatcatcaggt

SEQ ID NO: 40587 - DNA, 71 bp, chicken (Gallus Gallus)
  misc_feature (36): n=g or t
atgctaacaggggaacctatactcagggttggtggntttttctttccagcattgccttgctttctgcaggc

SEQ ID NO: 40588 - DNA, 71 bp, chicken (Gallus Gallus)
  misc_feature (36): n=c or t
tttgtgcccagatatgtgtacttggttatttcttangttctttgtaagcagtgcaagtctagcactgttcg

SEQ ID NO: 40589 - DNA, 71 bp, chicken (Gallus Gallus)
  misc_feature (36): n=a or g
gccttttcctaagccagagctttgtaacctcacggngcagccctgctgaagggttcttctaggcaaggctt

SEQ ID NO: 40590 - DNA, 71 bp, chicken (Gallus Gallus)
  misc_feature (36): n=a or g
gttgggagaacagccacgatgtgcacataagtcccngatttgccatatgggttctactgaatctgagctat

SEQ ID NO: 40591 - DNA, 71 bp, chicken (Gallus Gallus)
  misc_feature (36): n=a or g
atccccactttgttgaagggaacttttcaagacagnggaaaagcagcagccagggcaagtctggaagggtg

SEQ ID NO: 40592 - DNA, 71 bp, chicken (Gallus Gallus)
  misc_feature (36): n=a or g
tccgtgcgttctgactttagggagcgccaggcgaangcattggacgtctatatgtgtacttaggagctaaa

SEQ ID NO: 40593 - DNA, 71 bp, chicken (Gallus Gallus)
  misc_feature (36): n=c or t
ccacattctgcagtctattttagcattgctaatcanttttttccctggcattttaacacgagcagctcttc

SEQ ID NO: 40594 - DNA, 71 bp, chicken (Gallus Gallus)
  misc_feature (36): n=c or t
cctgctcttaaatatttccttagcaagccctcctcngtcctcagcttatctctgtggcattgctgtttcag

SEQ ID NO: 40595 - DNA, 71 bp, chicken (Gallus Gallus)
  misc_feature (36): n=a or g
cagcgggcaatctgcttacgcagtgcggggacctcntaagtgacattacgcaccaggagggcagcgagctc

SEQ ID NO: 40596 - DNA, 71 bp, chicken (Gallus Gallus)
  misc_feature (36): n=a or c
tgtgcaagaaaaatcagacacggattgtttcacagnttgcaaaggcagggaagcgttgagggagaagaatc

SEQ ID NO: 40597 - DNA, 71 bp, chicken (Gallus Gallus)
  misc_feature (36): n=c or t
acaagctgccagcgcagcaaagagagatcttatcantgcaacaggagagcgtttgtccttccctgggaaag

SEQ ID NO: 40598 - DNA, 71 bp, chicken (Gallus Gallus)
  misc_feature (36): n=a or g
tcccacacacatctgtccccccactgcatgtgatcncagcctcctgctgcccggtgctgcccacgctggcc

SEQ ID NO: 40599 - DNA, 71 bp, chicken (Gallus Gallus)
  misc_feature (36): n=c or t
ttattaaaccacgtatcactcatagtcctcttctantgggagaagcagtctcttgaacaagctgacctttt

SEQ ID NO: 40600 - DNA, 71 bp, chicken (Gallus Gallus)
  misc_feature (36): n=a or g
gaaaaaaccttgctttgaaaagatgtagcccttccnaagaggaacagaataacccttactggagacacgga

SEQ ID NO: 40601 - DNA, 71 bp, chicken (Gallus Gallus)
  misc_feature (36): n=c or t
caccacagccagcaaagggctttggcttttgttgcntttgtgcttaagaagtggttttgttctctttgacc

SEQ ID NO: 40602 - DNA, 71 bp, chicken (Gallus Gallus)
  misc_feature (36): n=g or t
caaccagagctaatagtggggacatacaagttattntcagggagtctcctcagccttttgctggaggtccc

SEQ ID NO: 40603 - DNA, 71 bp, chicken (Gallus Gallus)
  misc_feature (36): n=a or g
tgtgagatagagagctgaaatagcaccagggctgcntttgagggatgccctacgtgtccctttgcaccgat

SEQ ID NO: 40604 - DNA, 71 bp, chicken (Gallus Gallus)
  misc_feature (36): n=a or g
aggacgtgtccctccccaggagccgggcaggtcccngccgatcccaaaccccaccaggagaggctgcagtc

SEQ ID NO: 40605 - DNA, 71 bp, chicken (Gallus Gallus)
  misc_feature (36): n=a or g
tttaaggtctggttattgccaaaaggacacccagcngctccagaggaaagggcacttatcagtgggtgcaa

SEQ ID NO: 40606 - DNA, 71 bp, chicken (Gallus Gallus)
  misc_feature (36): n=a or g
ctctgactactctcatcaaagtactcctccgcaaanccactttggctctgactgtttagcaagtcaggatt

SEQ ID NO: 40607 - DNA, 71 bp, chicken (Gallus Gallus)
  misc_feature (36): n=c or t
cccatcctcgtgttctgcaccccacatccccgtgtncctccgtcctgcatcctcacacccccgtgctctgc

SEQ ID NO: 40608 - DNA, 71 bp, chicken (Gallus Gallus)
  misc_feature (36): n=a or g
gggggcagtgggagatgggccagaagtctgaaagcngtgttaaaaaggagcacaaagtgctcctcgttggg

SEQ ID NO: 40609 - DNA, 71 bp, chicken (Gallus Gallus)
  misc_feature (36): n=a or c
cctacaggtgttcgagcacatctggggcagagccangtcccaggatggccccaccggattccattgggtcc

SEQ ID NO: 40610 - DNA, 71 bp, chicken (Gallus Gallus)
  misc_feature (36): n=c or t
ggttacgtggcagatgacagcccttacaaggcacanagggaggttttgctatggagtatcttgggttaact

SEQ ID NO: 40611 - DNA, 71 bp, chicken (Gallus Gallus)
  misc_feature (36): n=a or g
atttgactctcgctttctctttgtgctcagggtagnaaaaaaaactgctgcagagggaatagccctcagca

SEQ ID NO: 40612 - DNA, 71 bp, chicken (Gallus Gallus)
  misc_feature (36): n=g or t
tgggtgccatctggtcaaacactgctttttgtatgnctaaatcagcatctttctgtcagacggtcgggtgg

SEQ ID NO: 40613 - DNA, 71 bp, chicken (Gallus Gallus)
  misc_feature (36): n=a or g
tgataacaaacagctcctggccagtccagaaggacntgagatgagctgcgttacacaccggatccgccccg

SEQ ID NO: 40614 - DNA, 71 bp, chicken (Gallus Gallus)
  misc_feature (36): n=c or t
ttattttttgctgtctcaaatgtctgtgtttcctgnagatcctgagtcctccctcacaagtctttgggtcc

SEQ ID NO: 40615 - DNA, 71 bp, chicken (Gallus Gallus)
  misc_feature (36): n=a or c
cacggtggaggttttgcttgctggtatttgtagctncacatggctgacctacacgcacttgtctgcacttg

SEQ ID NO: 40616 - DNA, 71 bp, chicken (Gallus Gallus)
  misc_feature (36): n=c or t
cagtcaacatgcttgcatttttagtttcaaattatnggcacaattgatctgcagatgtagtttgagtgata

SEQ ID NO: 40617 - DNA, 71 bp, chicken (Gallus Gallus)
  misc_feature (36): n=c or t
agtaattaaaagcctaacctagtctgcaaattaatngctgctaaatgaaccaatctacttaaactctgtgt

SEQ ID NO: 40618 - DNA, 71 bp, chicken (Gallus Gallus)
  misc_feature (36): n=c or t
tcctttaacctgttatctgctggtagatctcggcanggtgtgatggggctggaaactgttctccaaggcaa

SEQ ID NO: 40619 - DNA, 71 bp, chicken (Gallus Gallus)
  misc_feature (36): n=a or g
tgctgaggcaccacatgtggcaccaatgaagcttgnctatgtgatagatgaccgtaaattgtcccaaaagc

SEQ ID NO: 40620 - DNA, 71 bp, chicken (Gallus Gallus)
  misc_feature (36): n=a or c
aatcgtgctcctctcttaatagcaattaactttctnacatttggcttcaggatacttctgacttctctggc

SEQ ID NO: 40621 - DNA, 71 bp, chicken (Gallus Gallus)
  misc_feature (36): n=a or g
actacgaaagaaaaagggtattcaacatatttttantctagggatgctgaattgaggagcagcagagataa

SEQ ID NO: 40622 - DNA, 71 bp, chicken (Gallus Gallus)
  misc_feature (36): n=a or g
tacactgataatcttctaaaatgtgtttttggtacnttaggagaacaatttctgccaattcacattttgaa

SEQ ID NO: 40623 - DNA, 71 bp, chicken (Gallus Gallus)
  misc_feature (36): n=c or t
cctcccggcttactgctgtgcacagagggcaatgtntggggactggctaatgtttatagcttgcataagag

SEQ ID NO: 40624 - DNA, 71 bp, chicken (Gallus Gallus)
  misc_feature (36): n=a or c
aggaagtggtattcgacgccatcctgaagtggatcncccacgatccgtggcacaggaagcagcacatcccc

SEQ ID NO: 40625 - DNA, 71 bp, chicken (Gallus Gallus)
  misc_feature (36): n=a or g
tctgggtgcttcctcatggcatcagacatgttcttntagactgggatcaagatttctttgtggccccaata

SEQ ID NO: 40626 - DNA, 71 bp, chicken (Gallus Gallus)
  misc_feature (36): n=a or c
ccaccacacatacacagaagaacctcagatcctgancatttcattactgcatcacagctcatactgaactg

SEQ ID NO: 40627 - DNA, 71 bp, chicken (Gallus Gallus)
  misc_feature (36): n=a or g
tgtacagctcaaagtatatgggagaaaaactaaacncatctggactgttgctatgcttagagctacctcag

SEQ ID NO: 40628 - DNA, 71 bp, chicken (Gallus Gallus)
  misc_feature (36): n=c or t
cttgcctgctggtgacttagtactcgcaatgctgcncacacggcgggacaattgtggagggggacaatggg

SEQ ID NO: 40629 - DNA, 71 bp, chicken (Gallus Gallus)
  misc_feature (36): n=c or t
cctgtggtttcagatacattcctgctgaatgctgcngtggggtcagactctccatactgcagctcacagag

SEQ ID NO: 40630 - DNA, 71 bp, chicken (Gallus Gallus)
  misc_feature (36): n=a or g
tctcacaagggagaatgttactagttttaaaaggangtcaatgttgcttatgctaacatttatataatcta

SEQ ID NO: 40631 - DNA, 71 bp, chicken (Gallus Gallus)
  misc_feature (36): n=a or c
gctgacagcctacttgggtgagcactgagatgttcnggtgcctctctgtaatgaggtgagtggggatggac

SEQ ID NO: 40632 - DNA, 71 bp, chicken (Gallus Gallus)
  misc_feature (36): n=a or g
ccgcagcccccaaagaggatgacggacagacagacnaacgcaggaacggatgccttttacctgggaggtct

SEQ ID NO: 40633 - DNA, 71 bp, chicken (Gallus Gallus)
  misc_feature (36): n=a or c
cttctttggaggggtgatcgaccaggacaagcagcncctcacctaccggcaaaacttccgtggctgtgtgg

SEQ ID NO: 40634 - DNA, 71 bp, chicken (Gallus Gallus)
  misc_feature (36): n=g or t
gagcaaccagcagctggtggatatcattgagaaagngaaaccagagatcaggctgcttattgagaagtgta

SEQ ID NO: 40635 - DNA, 71 bp, chicken (Gallus Gallus)
  misc_feature (36): n=a or g
aatggggctattgaaggcaaagtccaggccacgggntacacgagctcgtcctttttccatgggaatggtct

SEQ ID NO: 40636 - DNA, 71 bp, chicken (Gallus Gallus)
  misc_feature (36): n=a or g
atcctacaattcctaaagaaacatatcatagtcaantgatacagagatacagcaaacagtatagaaccaac

SEQ ID NO: 40637 - DNA, 71 bp, chicken (Gallus Gallus)
  misc_feature (36): n=a or c
aaagttataatcttaggcttatgctatgttaccagntgtagttatgttagaagggtctcctaagttttata

SEQ ID NO: 40638 - DNA, 71 bp, chicken (Gallus Gallus)
  misc_feature (36): n=c or t
tatctagagctgtggtgaagtctacctagctaaatnccactaaagccatggttttctcctttggtcacccc

SEQ ID NO: 40639 - DNA, 71 bp, chicken (Gallus Gallus)
  misc_feature (36): n=c or t
ccatgcaacaaacaccactgtgggcaaactcagctnacgtgctggaagagtccaacaaaggcaagtgatgt

SEQ ID NO: 40640 - DNA, 71 bp, chicken (Gallus Gallus)
  misc_feature (36): n=a or g
gaatgcccaaaaatgactattaaagatgagaaagcnaaggaatgagcatcctaagatgatgggatagagat

SEQ ID NO: 40641 - DNA, 71 bp, chicken (Gallus Gallus)
  misc_feature (36): n=a or g
ttcctgatcagaaacgttcaagctctggcagagcanttgctatcacgaacacggatgggctgtcccatgct

SEQ ID NO: 40642 - DNA, 71 bp, chicken (Gallus Gallus)
  misc_feature (36): n=a or g
atacagctcccaaccacagcttttgttcctgcttcntagatctctcaccagagcacacaccacaacctcag

SEQ ID NO: 40643 - DNA, 71 bp, chicken (Gallus Gallus)
  misc_feature (36): n=a or c
tgagagcctgggcacaaaaggcaacacacgaagtanagaggaagcagaggatgtagaaatgtaaaggagag

SEQ ID NO: 40644 - DNA, 71 bp, chicken (Gallus Gallus)
  misc_feature (36): n=a or g
cttcgctctcccagccttgcctttggtgcccgtgcncacacatccccacgtaccccaaaagaccccgttcc

SEQ ID NO: 40645 - DNA, 71 bp, chicken (Gallus Gallus)
  misc_feature (36): n=a or g
accaggggatgctggggacacggggacaagggcacnttgaggacatggggacactggggaggtgaggacat

SEQ ID NO: 40646 - DNA, 71 bp, chicken (Gallus Gallus)
  misc_feature (36): n=c or t
aggagccagagctgcccgggggaccagagtgacccncctaccttgccggcaaagtggcacacaacgaaggc

SEQ ID NO: 40647 - DNA, 71 bp, chicken (Gallus Gallus)
  misc_feature (36): n=g or t
tttctttttaggtttgaacccaactctgggaaggtnccccaaggaacggggagatcagaaacaaacccaag

SEQ ID NO: 40648 - DNA, 71 bp, chicken (Gallus Gallus)
  misc_feature (36): n=a or g
gtgggatgcagtggggtggttcatacagcacaggtnaggcgttactgtgtgcatcccttcctcagagcacg

SEQ ID NO: 40649 - DNA, 71 bp, chicken (Gallus Gallus)
  misc_feature (36): n=c or t
gggaggaggggtgcgggtttgggatactgcccatcngctggccctataggaggggtcatgccccaaactgg

SEQ ID NO: 40650 - DNA, 71 bp, chicken (Gallus Gallus)
  misc_feature (36): n=c or t
tgacgtttatcccccatcaggacgtgcgttctgccngtgagcagcactgccctgctggctttctgggttct

SEQ ID NO: 40651 - DNA, 71 bp, chicken (Gallus Gallus)
  misc_feature (36): n=a or c
ctgcccctccggccacaagaacacaccaacacctantgagttttgccaccttacagagttaattgtatggt

SEQ ID NO: 40652 - DNA, 71 bp, chicken (Gallus Gallus)
  misc_feature (36): n=c or t
cacagtcacctcagggtaagcagcgagtgcagcttngagcagacagacagctctctgtagggcaggctgga

SEQ ID NO: 40653 - DNA, 71 bp, chicken (Gallus Gallus)
  misc_feature (36): n=a or g
agtctttcctgtaagaacgtcacattaagaccacantactgggattgggttggtgggatgatttttccatc

SEQ ID NO: 40654 - DNA, 71 bp, chicken (Gallus Gallus)
  misc_feature (36): n=a or g
ccacgcttgcattcctatcaaggtacagctgctgcntgcagcctggcgggctgaggggctgcgaagcagtg

SEQ ID NO: 40655 - DNA, 71 bp, chicken (Gallus Gallus)
  misc_feature (36): n=c or t
accacgtccgtcttgttctcgaagatgtcgtgcagngtgatgatgttggggtgttggatctccctcaggat

SEQ ID NO: 40656 - DNA, 71 bp, chicken (Gallus Gallus)
  misc_feature (36): n=c or t
aagattgaagctgggaatgagttcaagaacatattngggaccccggagttcgtgggtgaggcacagttttg

SEQ ID NO: 40657 - DNA, 71 bp, chicken (Gallus Gallus)
  misc_feature (36): n=c or t
aatgggactatacaatgtgaccccatggcactgcantgctctgtgttttgagcacccagacctctgcatgt

SEQ ID NO: 40658 - DNA, 71 bp, chicken (Gallus Gallus)
  misc_feature (36): n=c or t
gtgctgtggagcgtttctccaaaggttgggtggtantcccatctcaacaatgcaaaacccttcgtacccac

SEQ ID NO: 40659 - DNA, 71 bp, chicken (Gallus Gallus)
  misc_feature (36): n=a or g
ggctcccgggtgcctcatggtacgtgcctacacggngagatcctctcatttataaaacttggggacctccc

SEQ ID NO: 40660 - DNA, 71 bp, chicken (Gallus Gallus)
  misc_feature (36): n=a or c
tgacatcataacgtgctgattaccaaatggtgaganatgtaggatcttggctcttgacctgggaaagacgt

SEQ ID NO: 40661 - DNA, 71 bp, chicken (Gallus Gallus)
  misc_feature (36): n=c or t
ggaagtgttttgtgattgcattgctcagcatcagcnggagcagagcgcgaaaatcactcctttgaggtggg

SEQ ID NO: 40662 - DNA, 71 bp, chicken (Gallus Gallus)
  misc_feature (36): n=a or g
gtgctaggacacatatagaatggtgtatatgccacngcagcactaataacagaatggcataccaccagaac

SEQ ID NO: 40663 - DNA, 71 bp, chicken (Gallus Gallus)
  misc_feature (36): n=g or t
caggggcagcgggtcccaggccagcagcagtttggngggggggatgttgaggattgagtcggggatgggga

SEQ ID NO: 40664 - DNA, 71 bp, chicken (Gallus Gallus)
  misc_feature (36): n=c or t
acaatagggtgggggggcagagacatcatgagcccngggcccatccgtgtgaccctggctatagggcaaag

SEQ ID NO: 40665 - DNA, 71 bp, chicken (Gallus Gallus)
  misc_feature (36): n=a or g
tctgagctatcagctatgagcacctacagatgtacnctctgtggctctcatccacatactgaaatttcaac

SEQ ID NO: 40666 - DNA, 71 bp, chicken (Gallus Gallus)
  misc_feature (36): n=c or t
ataattttcagaggacaatttttgctcttcctgcanaaccaacaacacactgagcacttaaaataagaaca

SEQ ID NO: 40667 - DNA, 71 bp, chicken (Gallus Gallus)
  misc_feature (36): n=a or g
tctccagttagcagacggaatctgaccctgcagaangaataaaactgcagttagaggggccctgtgcactg

SEQ ID NO: 40668 - DNA, 71 bp, chicken (Gallus Gallus)
  misc_feature (36): n=a or c
aaccccatcctagctgctcctaccctgccctcagtncctggatgcattcacgctgcccagaggattcagtc

SEQ ID NO: 40669 - DNA, 71 bp, chicken (Gallus Gallus)
  misc_feature (36): n=a or g
gacatggaacaacagttttacctctcctgtagttcntgctaccaaatttgttaaaaagttcactttctgac

SEQ ID NO: 40670 - DNA, 71 bp, chicken (Gallus Gallus)
  misc_feature (36): n=c or t
tagacatgttaacaggaacaaggagaagcatcacantgacatggaataaagggtttcacgatgattttttc

SEQ ID NO: 40671 - DNA, 71 bp, chicken (Gallus Gallus)
  misc_feature (36): n=a or g
cttagtcagtgcagcagcattcactgggactgcagnaaaagacagtcccaaaaaaaaattgaaaaatccct

SEQ ID NO: 40672 - DNA, 71 bp, chicken (Gallus Gallus)
  misc_feature (36): n=a or g
tcttctttttttggttacaacacagtttaaatgctnaggacagataggacatgacttcgttctgctttggg

SEQ ID NO: 40673 - DNA, 71 bp, chicken (Gallus Gallus)
  misc_feature (36): n=a or g
cgcagcagctgccaagcaccgattctggtgagaagnggttttaaatcctcagggagctggaatgaaggggg

SEQ ID NO: 40674 - DNA, 71 bp, chicken (Gallus Gallus)
  misc_feature (36): n=a or c
atactctgtcatgacacccttgagcagaagtccccnatgaaggctgtttggcaaggcaaggtggaactgta

SEQ ID NO: 40675 - DNA, 71 bp, chicken (Gallus Gallus)
  misc_feature (36): n=a or g
tggactgtactgatgcctctgtttagggctggaggnacctcataggctattgtttttccaggacagtgtta

SEQ ID NO: 40676 - DNA, 71 bp, chicken (Gallus Gallus)
  misc_feature (36): n=c or t
gtttgagtatttgcttgcaagttagcatactttagnagcatacacactgtttgactttccctggagggaag

SEQ ID NO: 40677 - DNA, 71 bp, chicken (Gallus Gallus)
  misc_feature (36): n=c or t
acgttggagggcctcttgctggaagacttcaactcnggctgcggcccacccttcggagaggtgttctccag

SEQ ID NO: 40678 - DNA, 71 bp, chicken (Gallus Gallus)
  misc_feature (36): n=c or t
acgggggattttgctgtggggtttctcctcatcatntctcagacctgcggcggtccattagccctcctcca

SEQ ID NO: 40679 - DNA, 71 bp, chicken (Gallus Gallus)
  misc_feature (36): n=c or t
gagagaacctggagagcatctctcacagcagtggtngttctctggagcttcacatcttctcttgctttgtc

SEQ ID NO: 40680 - DNA, 71 bp, chicken (Gallus Gallus)
  misc_feature (36): n=c or t
tcctgcacgaccctgtcaggtcaattggagctgtgngactggagagggtattatcgttattagaggtcatt

SEQ ID NO: 40681 - DNA, 71 bp, chicken (Gallus Gallus)
  misc_feature (36): n=c or t
tacaagaccccattagtgacatcctccatggggacncacatccctcctgtgcaaaacgcagaccccacagg

SEQ ID NO: 40682 - DNA, 71 bp, chicken (Gallus Gallus)
  misc_feature (36): n=a or c
gcttccctagggctggaaactggagcaaaaaacccnctccctcctcaaggtgtaggaaaagaatgcaggta

SEQ ID NO: 40683 - DNA, 71 bp, chicken (Gallus Gallus)
  misc_feature (36): n=a or g
cgacgccaggccttctggatcacccgggcgaagccntcaaatttcctctccctcatctcctccaggaggaa

SEQ ID NO: 40684 - DNA, 71 bp, chicken (Gallus Gallus)
  misc_feature (36): n=a or g
ccagctgaaaggcagcatccttgcaatgggacaccngcagcacctccagcttaggccagagagtgaatatt

SEQ ID NO: 40685 - DNA, 71 bp, chicken (Gallus Gallus)
  misc_feature (36): n=a or g
actgtaaggatatacatctaactaacatctaattcngggcctgttgcagagattggagcagctgcaggaac

SEQ ID NO: 40686 - DNA, 71 bp, chicken (Gallus Gallus)
  misc_feature (36): n=a or g
atgggtacctactgacccaggccatttgtacaggantggggacagacaggcacctccagtttaggactgtt

SEQ ID NO: 40687 - DNA, 71 bp, chicken (Gallus Gallus)
  misc_feature (36): n=g or t
tttagagtagggatgcaacaaatggaagaaataatnaaactttcaacataaggaagaagacagtgtcttca

SEQ ID NO: 40688 - DNA, 71 bp, chicken (Gallus Gallus)
  misc_feature (36): n=c or t
aattcccagaaggaggagccatgcatatgcacggtncacacttaagctgtgaacatcatcacatgaggtta

SEQ ID NO: 40689 - DNA, 71 bp, chicken (Gallus Gallus)
  misc_feature (36): n=a or g
gacagcacagatgcacagcaagcccagaggctcagnctgagatgtgctaacaaacagcgtggggactggtg

SEQ ID NO: 40690 - DNA, 71 bp, chicken (Gallus Gallus)
  misc_feature (36): n=c or t
ttctgtgattctatagagacaaacctcaagaaatancagaactgtcaactatcatttattgactcaaatct

SEQ ID NO: 40691 - DNA, 71 bp, chicken (Gallus Gallus)
  misc_feature (36): n=a or g
aagagtctgcttgccataaagccaattccccattgngtctgttgaacactgagcagagcaaggtgcacagg

SEQ ID NO: 40692 - DNA, 71 bp, chicken (Gallus Gallus)
  misc_feature (36): n=a or g
gtttgtggtgttcagcaccaaatgtttaaagagctnaaaaggagactgttgaactgtctgtaatggagcag

SEQ ID NO: 40693 - DNA, 71 bp, chicken (Gallus Gallus)
  misc_feature (36): n=c or t
attccctaagcataagggttctgctcaaatagaaangaagtcctaccagctgcacttttggggggggtatc

SEQ ID NO: 40694 - DNA, 71 bp, chicken (Gallus Gallus)
  misc_feature (36): n=a or g
aaatttctgtggtttcacaccaataaagacgtgacncgtcgttcccaggcactctgtggtggttaacaact

SEQ ID NO: 40695 - DNA, 71 bp, chicken (Gallus Gallus)
  misc_feature (36): n=c or t
cgtttaccctcagtgagggctgatcctggggctgcngggagcagcagcgctttgcagagctgtcagaggga

SEQ ID NO: 40696 - DNA, 71 bp, chicken (Gallus Gallus)
  misc_feature (36): n=a or g
ggatggttttccaaatgatcccctttcctttttgcngaacgctcctctttttgcaggcacatcactaagac

SEQ ID NO: 40697 - DNA, 71 bp, chicken (Gallus Gallus)
  misc_feature (36): n=c or t
tgcagcacatggggtggcagacagggattggcacantgggggcatgagtccattgcacgcagccctgggct

SEQ ID NO: 40698 - DNA, 71 bp, chicken (Gallus Gallus)
  misc_feature (36): n=a or g
agaaacaggcagcagcagcactgctgcagcacatcngaggagaacaaatttctctagagaaccctcttagg

SEQ ID NO: 40699 - DNA, 71 bp, chicken (Gallus Gallus)
  misc_feature (36): n=a or g
ggaaaactgggagcaagtgaagcacatcagagaagntttggcaatgcacgttttgtgtgttgttttagcaa

SEQ ID NO: 40700 - DNA, 71 bp, chicken (Gallus Gallus)
  misc_feature (36): n=a or g
atgtcctgctttcactatgcccctataaagcaagcntgactcgccagctaactgcctgaccctactggagt

SEQ ID NO: 40701 - DNA, 71 bp, chicken (Gallus Gallus)
  misc_feature (36): n=c or t
cagcgccggtcagggggctcaatcctttgctcatangctgacatgaaccgatggcgaggcataatgctttc

SEQ ID NO: 40702 - DNA, 71 bp, chicken (Gallus Gallus)
  misc_feature (36): n=a or g
gctccttcctcctggccgagcttccctttggctctnaatagctttagaaacttccccacattcctttctgc

SEQ ID NO: 40703 - DNA, 71 bp, chicken (Gallus Gallus)
  misc_feature (36): n=c or t
atctgctctgctctctcatcaatgctgtatggaganagcctggaatggaacctccagtgaaaggctctcgt

SEQ ID NO: 40704 - DNA, 71 bp, chicken (Gallus Gallus)
  misc_feature (36): n=a or g
aagagccacgctctgcacagacacaaatcctgcacntggttggattagctttagaattacacaaaaacagt

SEQ ID NO: 40705 - DNA, 71 bp, chicken (Gallus Gallus)
  misc_feature (36): n=a or g
taacccaatggaaatcacgagaagtgcactctacantgaagctcagaggaagacagtggctgctaatggtg

SEQ ID NO: 40706 - DNA, 71 bp, chicken (Gallus Gallus)
  misc_feature (36): n=c or t
actcaatctcatcccaccagtgtccccacccccacngtgttcctcctctccccgagaaacgtaatctgctt

SEQ ID NO: 40707 - DNA, 71 bp, chicken (Gallus Gallus)
  misc_feature (36): n=c or t
tactccagaatggccattcctgctgggagctgcaangatcgcccattggcaaagagattttcttctaccat

SEQ ID NO: 40708 - DNA, 71 bp, chicken (Gallus Gallus)
  misc_feature (36): n=a or g
catgccatgtggacccaggctttgacatgcttcctncaggcctaggccccaatgtactgtgtaggcccagg

SEQ ID NO: 40709 - DNA, 71 bp, chicken (Gallus Gallus)
  misc_feature (36): n=a or g
tgaaagcctgaggggaagccaaatctgcaaggtacnctgctctgttctccctgggccttcttttgctatct

SEQ ID NO: 40710 - DNA, 71 bp, chicken (Gallus Gallus)
  misc_feature (36): n=a or g
cccccatcatcctgcagaggtgagtgctatggggtngtccccattgtagggttgtggtgtgggttggggtg

SEQ ID NO: 40711 - DNA, 71 bp, chicken (Gallus Gallus)
  misc_feature (36): n=a or g
tgcttgcaccccgtgctcccgtgcacaggttgggcngtctctgctggcactgtaagcaggatgctggaggt

SEQ ID NO: 40712 - DNA, 71 bp, chicken (Gallus Gallus)
  misc_feature (36): n=c or t
aaaattagatttggaagctgatccaaaagggagatnataaataaattgatgttgacagcaaaattaacaat

SEQ ID NO: 40713 - DNA, 71 bp, chicken (Gallus Gallus)
  misc_feature (36): n=a or g
aaggcaagaagttctgcttgtacctggaaggaagtnctgctggatgcaccggcgccagctctgcactgccg

SEQ ID NO: 40714 - DNA, 71 bp, chicken (Gallus Gallus)
  misc_feature (36): n=c or t
tccaatatgggtttggggtttattccaatacgtccngtttgggtttgggtttgaatttggggtttatttca

SEQ ID NO: 40715 - DNA, 71 bp, chicken (Gallus Gallus)
  misc_feature (36): n=a or c
gtttggggatggcagccttgggcacgagcggagggngaaagaaatgaaaggggtttattgctggcgcaaac

SEQ ID NO: 40716 - DNA, 71 bp, chicken (Gallus Gallus)
  misc_feature (36): n=g or t
ctaatccgacacgactcttccattagagctgagacnccggcaaagagctttttggtgtaggaattaactcc

SEQ ID NO: 40717 - DNA, 71 bp, chicken (Gallus Gallus)
  misc_feature (36): n=a or g
gacggtcctgctgacaaagcccctttcctggaagangcagcctttgctcagcccaccagaactgtgcccct

SEQ ID NO: 40718 - DNA, 71 bp, chicken (Gallus Gallus)
  misc_feature (36): n=a or g
agctagctgtgggcagcctttgaggggtattctgtnggctgtgttacaaacgatcagttaaagcacagtga

SEQ ID NO: 40719 - DNA, 71 bp, chicken (Gallus Gallus)
  misc_feature (36): n=c or t
tgaaaacttccacaatggaaatagggcacaatgacngggctgaactgcgggacttggtagggctggaggtc

SEQ ID NO: 40720 - DNA, 71 bp, chicken (Gallus Gallus)
  misc_feature (36): n=c or t
tctcagctcctgggtgaacattttctataacttatncccagaataatctcagcagagccctaaaaccatct

SEQ ID NO: 40721 - DNA, 71 bp, chicken (Gallus Gallus)
  misc_feature (36): n=a or g
gagctctggaagtgggaactttgaccaggagggcanaaaactgctaaatttcttcaggccttggctgcccc

SEQ ID NO: 40722 - DNA, 71 bp, chicken (Gallus Gallus)
  misc_feature (36): n=c or t
cagcatcaccagcccccagcaccgcagccccagcantgcagcaggcctttagaaagggctccattgcagct

SEQ ID NO: 40723 - DNA, 71 bp, chicken (Gallus Gallus)
  misc_feature (36): n=g or t
cacgccggtcggctccccgcagggccttgcaggtangtgacagcgttgttcctcctataaagaggcccacc

SEQ ID NO: 40724 - DNA, 71 bp, chicken (Gallus Gallus)
  misc_feature (36): n=a or g
ggttttctgtttcttccctctccttcgccaaaatcncttccaaaatgttttctgccctcttcttcccagct

SEQ ID NO: 40725 - DNA, 71 bp, chicken (Gallus Gallus)
  misc_feature (36): n=c or t
catttggaacaaatccatacttgaattctttcatgnttcctaaatctaaaatgtaaagttttaggaaactg

SEQ ID NO: 40726 - DNA, 71 bp, chicken (Gallus Gallus)
  misc_feature (36): n=c or t
aaaaaggctagaatagaggttgaattctcacttcanattcctactgtggttgacttgtctatataaagttt

SEQ ID NO: 40727 - DNA, 71 bp, chicken (Gallus Gallus)
  misc_feature (36): n=c or t
cacatctggggacaacaggagggggggcatggaganagcatcacacacagccccacggccagccagcaccc

SEQ ID NO: 40728 - DNA, 71 bp, chicken (Gallus Gallus)
  misc_feature (36): n=g or t
cacaccgccttggataatcaatgggaaagtggtggngtaggaatcagccccgcatacccctccccagcagc

SEQ ID NO: 40729 - DNA, 71 bp, chicken (Gallus Gallus)
  misc_feature (36): n=c or t
ctttcttttaaggaaaattcactcctttttggcaangtgctgctcctacctcacacctgggagagctgagc

SEQ ID NO: 40730 - DNA, 71 bp, chicken (Gallus Gallus)
  misc_feature (36): n=a or g
tagtccacagcttgcaggagcttctcatcattcttngtccagtcctgactctgcaatgaagccaacgtgag

SEQ ID NO: 40731 - DNA, 71 bp, chicken (Gallus Gallus)
  misc_feature (36): n=a or g
ctgaacattcactaaaagtggagacccgtgagactngtgtcagcacaccacaccttccctggcacagctcc

SEQ ID NO: 40732 - DNA, 71 bp, chicken (Gallus Gallus)
  misc_feature (36): n=a or g
actctattgcaaactaacttaatcagactcatttcnctgctaactgctgtagctttttacacctctagaag

SEQ ID NO: 40733 - DNA, 71 bp, chicken (Gallus Gallus)
  misc_feature (36): n=g or t
agcagtggatgccacgcacgtcgaccagagcgtcgnaaagatcctcggcgcagatgagctgcactcggagc

SEQ ID NO: 40734 - DNA, 71 bp, chicken (Gallus Gallus)
  misc_feature (36): n=a or g
gtttttgcagtgcttcttctgacattgccttcagcnttaatcattcctttgtttttccctacagagcagca

SEQ ID NO: 40735 - DNA, 71 bp, chicken (Gallus Gallus)
  misc_feature (36): n=c or t
agacagtaatttaggggagaaagaccaaaagggatngctgtcacttcatgtcttggttctttgcagatggg

SEQ ID NO: 40736 - DNA, 71 bp, chicken (Gallus Gallus)
  misc_feature (36): n=c or t
aacaggggagcagcctggggttcacagtgctagttntgtttgggtgcattgcctcaagtcccacttaaccc

SEQ ID NO: 40737 - DNA, 71 bp, chicken (Gallus Gallus)
  misc_feature (36): n=c or t
taactctttacatccaggtttcttggacaggtgctngacctcacgaatagcagatgttaacttctctgcat

SEQ ID NO: 40738 - DNA, 71 bp, chicken (Gallus Gallus)
  misc_feature (36): n=c or t
caagtgctgatccacgttctgggagggagagaattngagagcagattgtgatgagaacagaaataaatgaa

SEQ ID NO: 40739 - DNA, 71 bp, chicken (Gallus Gallus)
  misc_feature (36): n=c or t
ccagtgaagcactcttcccagtgtcctggaggaagncataaagcctggctgcagacagccacacaatggca

SEQ ID NO: 40740 - DNA, 71 bp, chicken (Gallus Gallus)
  misc_feature (36): n=c or t
aaaggatcatggcagaggtgagacacaacacagcanctattccaagcacaaagaacagtcctcactagccc

SEQ ID NO: 40741 - DNA, 71 bp, chicken (Gallus Gallus)
  misc_feature (36): n=c or t
tctgctagaaataattggttttggtataatttatgntgtaagatacactcaccatgctgctgtttcttatc

SEQ ID NO: 40742 - DNA, 71 bp, chicken (Gallus Gallus)
  misc_feature (36): n=c or t
aagttttacattaagtggcagcaaaagatgcccaantgaaagcactgtacactggaatcctgtccgaactg

SEQ ID NO: 40743 - DNA, 71 bp, chicken (Gallus Gallus)
  misc_feature (36): n=g or t
aaaacaggttttctgagtgccaggttgtatgcaatnctatgaccaacaaatctggtttccaagatgctgaa

SEQ ID NO: 40744 - DNA, 71 bp, chicken (Gallus Gallus)
  misc_feature (36): n=a or g
agcatcacccaaatagcaaattccacgtgtgagtgngagggaacttcaccaccaagagcaatgtgatgtaa

SEQ ID NO: 40745 - DNA, 71 bp, chicken (Gallus Gallus)
  misc_feature (36): n=a or g
gtcaactgatccgctgctaactcaacccaaccaccnggaaaggctacccaaccttattcagaaaggttgta

SEQ ID NO: 40746 - DNA, 71 bp, chicken (Gallus Gallus)
  misc_feature (36): n=c or t
ggacacacaacaccccatgccaggcttgggatgctnggaggggctgcgtcccccaacctgtccttgatctt

SEQ ID NO: 40747 - DNA, 71 bp, chicken (Gallus Gallus)
  misc_feature (36): n=c or t
gtgacccttctgctcgagcctcactctgcccgaccnctaaggagactgatgtgtccctctgctctctgtcc

SEQ ID NO: 40748 - DNA, 71 bp, chicken (Gallus Gallus)
  misc_feature (36): n=a or g
tcagtaactgtcccatgaagcttgtatgcagggacntgtgtttcctgtgaaacatctagaaaaacatctct

SEQ ID NO: 40749 - DNA, 71 bp, chicken (Gallus Gallus)
  misc_feature (36): n=c or t
tcctggcttttaatgtaaatgttctgattctggtcntaaggttgtagtctcatgaaaagtatggaaaggac

SEQ ID NO: 40750 - DNA, 71 bp, chicken (Gallus Gallus)
  misc_feature (36): n=g or t
agaaacaaaggacaagtggagaagtatgacggcggngccttatctggaagatctgcatggctacaatgagg

SEQ ID NO: 40751 - DNA, 71 bp, chicken (Gallus Gallus)
  misc_feature (36): n=c or t
caccatttctaactgttgctccaatgctttccaagngttggaccttcaccttttccatcgaagcacaccag

SEQ ID NO: 40752 - DNA, 71 bp, chicken (Gallus Gallus)
  misc_feature (36): n=c or t
tgtcagaattagtgttggagtaattgcagaagctcnccaaggttaatgctccattagcgagcagctctcgc

SEQ ID NO: 40753 - DNA, 71 bp, chicken (Gallus Gallus)
  misc_feature (36): n=c or t
ttgtctgcagactgcactgctgatggctggcagatnagccacaactgctgatcctttaagataagagtaac

SEQ ID NO: 40754 - DNA, 71 bp, chicken (Gallus Gallus)
  misc_feature (36): n=c or t
tatggctgtagttaaggagactttatgatattgtanctgaacaattgcctgctattatctggatcgatgca

SEQ ID NO: 40755 - DNA, 71 bp, chicken (Gallus Gallus)
  misc_feature (36): n=c or t
cacaagctcataaagtgctctaaatgcctgcttttntcatgtaggttttgcccaagcttgctgaggagccg

SEQ ID NO: 40756 - DNA, 71 bp, chicken (Gallus Gallus)
  misc_feature (36): n=c or t
aaggcctctcatcaagaaagcccttatttggggctntcatgtgtatgtgtagcccttatatttggggcttt

SEQ ID NO: 40757 - DNA, 71 bp, chicken (Gallus Gallus)
  misc_feature (36): n=c or t
tgggcttttgtgtaccacttaatgctgcatttagtnacccttattttcatgtgtagcatgtgtctgctcct

SEQ ID NO: 40758 - DNA, 71 bp, chicken (Gallus Gallus)
  misc_feature (36): n=a or g
cttggcccataaaatgtagatccataagggaccctnggaggatatccagcctattccacagcctagagcaa

SEQ ID NO: 40759 - DNA, 71 bp, chicken (Gallus Gallus)
  misc_feature (36): n=a or g
gttccttctactcagcttgcctccagaggtaaagcntggactccagttttgccacattaaacatttctcta

SEQ ID NO: 40760 - DNA, 71 bp, chicken (Gallus Gallus)
  misc_feature (36): n=g or t
ggcatgtccccaggacgggtgatgtgtcccctaggngggcagtatgtcccccaggtggatgatacgtcccc

SEQ ID NO: 40761 - DNA, 71 bp, chicken (Gallus Gallus)
  misc_feature (36): n=g or t
tgcgcaaacatttcgctgcttctggaaaatagatgnggggaggaggcggtgacagccatcgcggtcatggg

SEQ ID NO: 40762 - DNA, 71 bp, chicken (Gallus Gallus)
  misc_feature (36): n=a or g
atgactagtcaataattcaccgttgcaaagatagtncatagttctgttctcacgtctaaacaaaggtgttt

SEQ ID NO: 40763 - DNA, 71 bp, chicken (Gallus Gallus)
  misc_feature (36): n=a or g
ggtaattgctttgagaaatataagttcaccaacttngagtaaggcttcttatttctcatagagcttattct

SEQ ID NO: 40764 - DNA, 71 bp, chicken (Gallus Gallus)
  misc_feature (36): n=c or t
tccatgctgcaggtaggaaatggtttgcaaggaaanttaatccctgttggtttgttcttttctagatgtgg

SEQ ID NO: 40765 - DNA, 71 bp, chicken (Gallus Gallus)
  misc_feature (36): n=a or g
ttgacaaggggacacggggacaccccacacctgccntggccttaggacaaatcccatcccatcccgttggt

SEQ ID NO: 40766 - DNA, 71 bp, chicken (Gallus Gallus)
  misc_feature (36): n=g or t
cccctcctccccgcgtcggtgcatcctccccgaacnccctctcggttgttttgcacaaaccctgaaatatt

SEQ ID NO: 40767 - DNA, 71 bp, chicken (Gallus Gallus)
  misc_feature (36): n=c or t
gttaggaatggctggattcgttgttaaagggactcngagctgggagcaggaaaagaagaggcaacatttaa

SEQ ID NO: 40768 - DNA, 71 bp, chicken (Gallus Gallus)
  misc_feature (36): n=a or c
cctgctccctatttttcttgtgattcaccatttagnccctaggagagcttttgttgtgtagtgtctgcttt

SEQ ID NO: 40769 - DNA, 71 bp, chicken (Gallus Gallus)
  misc_feature (36): n=c or t
cagaatttgaataacctgggctggtgatctctgtanagctgaaaatctcccttcttcacgttctttgcttc

SEQ ID NO: 40770 - DNA, 71 bp, chicken (Gallus Gallus)
  misc_feature (36): n=c or t
cccggaacgctgccatgccgctgcttactcaacccnggtgacttccggtcgccttcgtgctctcattggcc

SEQ ID NO: 40771 - DNA, 71 bp, chicken (Gallus Gallus)
  misc_feature (36): n=a or g
aatcaaattttgtctgacagggaacgtgtttctacntgggaagtttgtaggagtatggtttttattgtgtc

SEQ ID NO: 40772 - DNA, 71 bp, chicken (Gallus Gallus)
  misc_feature (36): n=c or t
gagaaagcaaaacaagagttgtattctggctgtcangagagaaacagatccccagaactcgtatcagggag

SEQ ID NO: 40773 - DNA, 71 bp, chicken (Gallus Gallus)
  misc_feature (36): n=a or g
aagcattagcttgaggcctggaccactccaaagaangaaggcaaaaatacaaggatgtagcctctgcctcc

SEQ ID NO: 40774 - DNA, 71 bp, chicken (Gallus Gallus)
  misc_feature (36): n=a or g
gctccaacgctgctcctcagctcgatggctatctcntcaccataatctgtagaacctcgttaagtagtaat

SEQ ID NO: 40775 - DNA, 71 bp, chicken (Gallus Gallus)
  misc_feature (36): n=a or g
tctaaatggcaccttcaagaaaacccttccccagangacaaactgacatatgtcactggaaagccaggagg

SEQ ID NO: 40776 - DNA, 71 bp, chicken (Gallus Gallus)
  misc_feature (36): n=a or g
actttttttttgcgttttgagtatttccggcatctntaatagaacagtattacccagttagcctgtaggaa

SEQ ID NO: 40777 - DNA, 71 bp, chicken (Gallus Gallus)
  misc_feature (36): n=c or t
agacagcttcatcgtcatcctcttggccactcattnctgcacagatatggctccaggttggagtcacattc

SEQ ID NO: 40778 - DNA, 71 bp, chicken (Gallus Gallus)
  misc_feature (36): n=a or g
caatatgtaggaactctcccactgttgtgagctccntttccaatctgaaggacaatggcaacacctctctt

SEQ ID NO: 40779 - DNA, 71 bp, chicken (Gallus Gallus)
  misc_feature (36): n=a or g
gaatctctgggaagggctgtgtcagtgccctggctntgcactgcttgtgggtggtatggtgggcagcacac

SEQ ID NO: 40780 - DNA, 71 bp, chicken (Gallus Gallus)
  misc_feature (36): n=a or g
gaagcgctcgttcatctgctgcatgcgcaggctggncaggttgttgaagttgagcagcatctcgttcgtct

SEQ ID NO: 40781 - DNA, 71 bp, chicken (Gallus Gallus)
  misc_feature (36): n=a or g
cacggattagtggtgttcccagcagtgcttctcacntggcccattgggcagcagaccacagctgtcacttt

SEQ ID NO: 40782 - DNA, 71 bp, chicken (Gallus Gallus)
  misc_feature (36): n=a or g
taagatgagcaggaatgctgtgggaaaggcctcacntgtgctgagaatccagtcaggaatgggcccaccaa

SEQ ID NO: 40783 - DNA, 71 bp, chicken (Gallus Gallus)
  misc_feature (36): n=a or g
accttcgcatgcccaaagatacatcacagcggaacnaaaagtaaacctcaaaatgccgttctttgtattaa

SEQ ID NO: 40784 - DNA, 71 bp, chicken (Gallus Gallus)
  misc_feature (36): n=c or t
atgcgtgtacctcagcctttcagatgtttaaacagnatccacaagtttgccctcagattgccctgcactaa

SEQ ID NO: 40785 - DNA, 71 bp, chicken (Gallus Gallus)
  misc_feature (36): n=c or t
ctgttaaagagtacagcattcagtttggaagcttgnaattcatttcatagtcagagatgtaattaacagtt

SEQ ID NO: 40786 - DNA, 71 bp, chicken (Gallus Gallus)
  misc_feature (36): n=c or t
tctggtccttgtaaggaagcactaattaagaacatngccttttcctcattagctacctctcttacgatcag

SEQ ID NO: 40787 - DNA, 71 bp, chicken (Gallus Gallus)
  misc_feature (36): n=g or t
gcaacaatttcttcccatttgcttcttatctccttngttgaaagcgtcccatcaaagagaactggccctgc

SEQ ID NO: 40788 - DNA, 71 bp, chicken (Gallus Gallus)
  misc_feature (36): n=g or t
agagaagtcagtggtttctgaagagagaggatttcngtccagcagttcttacagacgaccgaggcagagtt

SEQ ID NO: 40789 - DNA, 71 bp, chicken (Gallus Gallus)
  misc_feature (36): n=a or g
aacattagtcatgtattttgatatgaataactaccntctccatttcaccattaaactgcggtcaaacaggt

SEQ ID NO: 40790 - DNA, 71 bp, chicken (Gallus Gallus)
  misc_feature (36): n=c or t
atccttaaactcgttttactttcttgcacctggctncaagtgcactggtttgcaactcttcccaaagtagt

SEQ ID NO: 40791 - DNA, 71 bp, chicken (Gallus Gallus)
  misc_feature (36): n=a or c
tcagggcctgaggcagctcaccaaggcactagcaancttgtcttagggtgctgggagatgaagacagcttt

SEQ ID NO: 40792 - DNA, 71 bp, chicken (Gallus Gallus)
  misc_feature (36): n=g or t
atcctgtgctgttgctgttgttaacttgggaggacntattcttgtcactggtttgtcatattgctcattta

SEQ ID NO: 40793 - DNA, 71 bp, chicken (Gallus Gallus)
  misc_feature (36): n=c or t
agtctgtgccagcagcaagattaggttccctcaganatatctaggtcagtgtgcgcttttgttgtcctggc

SEQ ID NO: 40794 - DNA, 71 bp, chicken (Gallus Gallus)
  misc_feature (36): n=a or g
cggtgcaggcacatgcaatctgcatctctcgtgggnactctgagccaatcgcacgttagttataaaaggca

SEQ ID NO: 40795 - DNA, 71 bp, chicken (Gallus Gallus)
  misc_feature (36): n=c or t
cccactgagaacagtgaagcatttcagcaaattcanagtgaagaattaatttaaagcttgagttcatgtag

SEQ ID NO: 40796 - DNA, 71 bp, chicken (Gallus Gallus)
  misc_feature (36): n=c or t
gtctactgtttgtacaagagagcactttacaacatnctagtttattgtagctgtgaaatggccaagtactt

SEQ ID NO: 40797 - DNA, 71 bp, chicken (Gallus Gallus)
  misc_feature (36): n=c or t
tgattcaccctcttccctttttctgagtttcacatngcagagaacagagttatttttcagcacaactttta

SEQ ID NO: 40798 - DNA, 71 bp, chicken (Gallus Gallus)
  misc_feature (36): n=a or g
aaaacatcttcatgtttttccagcgatgggtcctcntgaaatgttttccttgtttgtttggtgggttgtga

SEQ ID NO: 40799 - DNA, 71 bp, chicken (Gallus Gallus)
  misc_feature (36): n=c or t
ttttataataatctgccctcatgactttaatagccnatgtgaagtatcagcagttgagtttcacatccagt

SEQ ID NO: 40800 - DNA, 71 bp, chicken (Gallus Gallus)
  misc_feature (36): n=c or t
agtggaacgtttgtgcacaaatgtgacacacttttncccaaagtcagactttgcagttttcagagaattaa

SEQ ID NO: 40801 - DNA, 71 bp, chicken (Gallus Gallus)
  misc_feature (36): n=c or t
gattaaacggacagttctacctgcagaattcaaagntaaatgtaatggcttgttccaaaaaccttcgtgtt

SEQ ID NO: 40802 - DNA, 71 bp, chicken (Gallus Gallus)
  misc_feature (36): n=c or t
accatttgactctgctttcacctaaatttagactgncaaaacagttcactcaaaacagtttatgtttcagt

SEQ ID NO: 40803 - DNA, 71 bp, chicken (Gallus Gallus)
  misc_feature (36): n=g or t
tgctttgctgaaattctggtaggttgcattaatttnaatttctttctctcaatggtgattttgttcaagag

SEQ ID NO: 40804 - DNA, 71 bp, chicken (Gallus Gallus)
  misc_feature (36): n=a or g
gctaaatagcatctctgggaaggccaaatgcagccngatagacgctaatgcttcacattgactttgcttga

SEQ ID NO: 40805 - DNA, 71 bp, chicken (Gallus Gallus)
  misc_feature (36): n=c or t
actaggtcataccactggtggtctgttgttctgtcntgtcacttatttaagcggcatacagcttgccctag

SEQ ID NO: 40806 - DNA, 71 bp, chicken (Gallus Gallus)
  misc_feature (36): n=a or c
ctatgaaatcacactgctgcactttctacaagaatncctctgagagcacatgcctctgcaaactggatgct

SEQ ID NO: 40807 - DNA, 71 bp, chicken (Gallus Gallus)
  misc_feature (36): n=g or t
gagaagggatcactccttccatcgtgctctggacanggggaatctgagccaagccgggctgctggggctcc

SEQ ID NO: 40808 - DNA, 71 bp, chicken (Gallus Gallus)
  misc_feature (36): n=a or g
aaagtgcaagtctctaaggaattagagggcacgtcntggaggtgtggtgcaaactgaaagtgggtgtattc

SEQ ID NO: 40809 - DNA, 71 bp, chicken (Gallus Gallus)
  misc_feature (36): n=c or t
ataaagaggagtaagcattaagattcagctgggacncaacactcatccaaggggcctgaaagacacagtgc

SEQ ID NO: 40810 - DNA, 71 bp, chicken (Gallus Gallus)
  misc_feature (36): n=c or t
cgacaagcaaccttagcacaaccctttcaaatcctncagcgctaaaagccgcgcggtggggaccaaaaacc

SEQ ID NO: 40811 - DNA, 71 bp, chicken (Gallus Gallus)
  misc_feature (36): n=a or g
ttttgaatgatacatcacccagtggttctggttcancagcgaccgaactcagtttcccagcagagctggga

SEQ ID NO: 40812 - DNA, 71 bp, chicken (Gallus Gallus)
  misc_feature (36): n=c or t
tgaaatacggtaatctggaatttgcattgctgtttnatttcctttttctgcccattcttacagagtggaat

SEQ ID NO: 40813 - DNA, 71 bp, chicken (Gallus Gallus)
  misc_feature (36): n=c or t
gcattttcttgttcccaagatttcctcaccagcacntccctcctgatccttcagaaacctggcctcaatta

SEQ ID NO: 40814 - DNA, 71 bp, chicken (Gallus Gallus)
  misc_feature (36): n=a or g
tctgagcttcattttagaactcttcagcaagcaacncagatgcaactctacagcacaggtcaaggctggta

SEQ ID NO: 40815 - DNA, 71 bp, chicken (Gallus Gallus)
  misc_feature (36): n=a or g
aagctgggcagtgtggggactcgagaccttggggtntacacactgggagcagctacagctcacaattagca

SEQ ID NO: 40816 - DNA, 71 bp, chicken (Gallus Gallus)
  misc_feature (36): n=a or c
atgtgtgtaggagaaactgatacaacagcaccccanagtccattgctttggttgtgtgagtcactgagggc

SEQ ID NO: 40817 - DNA, 71 bp, chicken (Gallus Gallus)
  misc_feature (36): n=a or g
ggtatgagtgtaaatccactacagctgtaggttcangcttgtcattcttagccctgcttatctgagcacct

SEQ ID NO: 40818 - DNA, 71 bp, chicken (Gallus Gallus)
  misc_feature (36): n=a or g
ggttatctggcacagactccaacagcagagggaagnggaggcggctcatggcttctgcccccactttcagc

SEQ ID NO: 40819 - DNA, 71 bp, chicken (Gallus Gallus)
  misc_feature (36): n=g or t
ttacacggctcttttcacagcctgcatcatttgcancccttccagctccatcagcagcccatctccaacac

SEQ ID NO: 40820 - DNA, 71 bp, chicken (Gallus Gallus)
  misc_feature (36): n=g or t
agcatgcttttctgggtgctttttgaaggaaagatnttaaggatgactctgaaggaggtcaggttgtatac

SEQ ID NO: 40821 - DNA, 71 bp, chicken (Gallus Gallus)
  misc_feature (36): n=c or t
tatcagttacattaattagaaaaagtgctttggaangaactcccaaataacacatcttcagggtgagggat

SEQ ID NO: 40822 - DNA, 71 bp, chicken (Gallus Gallus)
  misc_feature (36): n=c or t
catgtgcatcagagctttgacttggatcaatcatgngtttctgaaatgcttctgcttaccatgctttggct

SEQ ID NO: 40823 - DNA, 71 bp, chicken (Gallus Gallus)
  misc_feature (36): n=a or c
tgcatcaagaagttctgaacttaggattaaaaaaanccactttgttgatgttgctttgtgaaggtgttgga

SEQ ID NO: 40824 - DNA, 71 bp, chicken (Gallus Gallus)
  misc_feature (36): n=c or t
tataacccactgccctgtctcattatagagggaaancctaattgcttacctcaaaactacaacaatcactg

SEQ ID NO: 40825 - DNA, 71 bp, chicken (Gallus Gallus)
  misc_feature (36): n=a or g
tgatgaatgtgtaaggagagcgggatgaagggctgnagagaagagtgctggctgtgagcaagcacatcaga

SEQ ID NO: 40826 - DNA, 71 bp, chicken (Gallus Gallus)
  misc_feature (36): n=c or t
agggctccatcttggagggcactctctgacccacangggctcagcaaaggagggatacagtctgtgagcac

SEQ ID NO: 40827 - DNA, 71 bp, chicken (Gallus Gallus)
  misc_feature (36): n=a or g
cagcatgcatccttggacctaattttcccagctgcnacattcacactcactgaatctaaatgttattttca

SEQ ID NO: 40828 - DNA, 71 bp, chicken (Gallus Gallus)
  misc_feature (36): n=a or g
tccctggtgctgatactgttcagctgtactgttacngagcagaatgaggctacaaggtccttgcagggcag

SEQ ID NO: 40829 - DNA, 71 bp, chicken (Gallus Gallus)
  misc_feature (36): n=g or t
gctgagtaaagcaaaacgccacgggagagcatcccntcccaaccacagcggtgccgtgggaaccatcagca

SEQ ID NO: 40830 - DNA, 71 bp, chicken (Gallus Gallus)
  misc_feature (36): n=a or g
agagggctttgcttcccggaggacctcgcttcaatnagcagtttgttctaccattcagctgctgctttggg

SEQ ID NO: 40831 - DNA, 71 bp, chicken (Gallus Gallus)
  misc_feature (36): n=a or g
agtaacaccgagcgtttgcttcacgcctgttgtganagtcagtgttcttaatgggaaaaacccaaacaaat

SEQ ID NO: 40832 - DNA, 71 bp, chicken (Gallus Gallus)
  misc_feature (36): n=a or g
ccatcgcttcttcccatgcatggtgtgacatccatncttgatgtgacatccctagctggccctacagctgg

SEQ ID NO: 40833 - DNA, 71 bp, chicken (Gallus Gallus)
  misc_feature (36): n=a or g
tttcctcctggctcccttggcgtgtccttggtgacntttgctgcagtccttgctggaggggcagggttcag

SEQ ID NO: 40834 - DNA, 71 bp, chicken (Gallus Gallus)
  misc_feature (36): n=c or t
caaaagtgtttgtctgtattttagtgggatggcttnacaggaggcactgagcattgcttatctcagatatt

SEQ ID NO: 40835 - DNA, 71 bp, chicken (Gallus Gallus)
  misc_feature (36): n=g or t
ctcagtctggattagtatttggaaatatattagttncagctaattgcagtatttgcttttgctgtaattgg

SEQ ID NO: 40836 - DNA, 71 bp, chicken (Gallus Gallus)
  misc_feature (36): n=c or t
gattctccatggccccatacaatctggccctgcagngttatgaataatgcctggactggcacagaattttt

SEQ ID NO: 40837 - DNA, 71 bp, chicken (Gallus Gallus)
  misc_feature (36): n=g or t
ttaccacttgacccattttatgtccacttgtcaaangaaccacctagaagttccaatttccatctgctgag

SEQ ID NO: 40838 - DNA, 71 bp, chicken (Gallus Gallus)
  misc_feature (36): n=c or t
gtttccacaggcaaaggtttgcatatcttcagtgtnaattcactttaataaataggcactctttaaaaagc

SEQ ID NO: 40839 - DNA, 71 bp, chicken (Gallus Gallus)
  misc_feature (36): n=c or t
aaacctcttctgcagcgtaaaatgcttgtcacttanatgctgtctgaatctgtgaacttgataatatttat

SEQ ID NO: 40840 - DNA, 71 bp, chicken (Gallus Gallus)
  misc_feature (36): n=c or t
tctcagttattacagcacccctggcaatcaccttcntttgcatcaacacagcagataccaggaaaagatgt

SEQ ID NO: 40841 - DNA, 71 bp, chicken (Gallus Gallus)
  misc_feature (36): n=c or t
tgtcttgaacagatccagtcacaagtaatcagaatncatgcataggacagggaggtgcttataacctgcta

SEQ ID NO: 40842 - DNA, 71 bp, chicken (Gallus Gallus)
  misc_feature (36): n=a or c
agaagagatgtaaagaatggtaagaaatcattacanttctagtttttggccattattactcatgttgatgg

SEQ ID NO: 40843 - DNA, 71 bp, chicken (Gallus Gallus)
  misc_feature (36): n=a or c
aaagctattaacatttctgctgcaggtagctgagcnaagtcctctcttacgcatccgctgtctgctaagga

SEQ ID NO: 40844 - DNA, 71 bp, chicken (Gallus Gallus)
  misc_feature (36): n=a or c
cagaatcagagtacttaatttggtacatttgtctcnaaaattgtaaggtaaattgcaaattatccttatgc

SEQ ID NO: 40845 - DNA, 71 bp, chicken (Gallus Gallus)
  misc_feature (36): n=g or t
tgtcacaggtcattgaattccaccactttacctctntacctctgtacaataaattaaacatgatttaaaag

SEQ ID NO: 40846 - DNA, 71 bp, chicken (Gallus Gallus)
  misc_feature (36): n=g or t
gttgatgcgtgctccatacacatacagcaagcttanacagacgtgacagaggcaggaataatggcaacgag

SEQ ID NO: 40847 - DNA, 71 bp, chicken (Gallus Gallus)
  misc_feature (36): n=a or c
tggctcaatgctcctattcctgcagcatctgagcanttcacattctgtgatgggcacttcctttctgtaag

SEQ ID NO: 40848 - DNA, 71 bp, chicken (Gallus Gallus)
  misc_feature (36): n=c or t
taacttcctatgaagagcagtagccattactacagnttaaaaagggggcaaatttctgatgcagaaaatag

SEQ ID NO: 40849 - DNA, 71 bp, chicken (Gallus Gallus)
  misc_feature (36): n=a or g
aaaatcctgacacatcaacactgctggatgaggtcnttgctcatagaaaagggtgccagctggggaacctg

SEQ ID NO: 40850 - DNA, 71 bp, chicken (Gallus Gallus)
  misc_feature (36): n=g or t
aaggctttagttattgtgtcactagagcggagcacncaagggaaagccaagactattggagaaaagaggag

SEQ ID NO: 40851 - DNA, 71 bp, chicken (Gallus Gallus)
  misc_feature (36): n=a or g
tgaagacgaagcagagaaacagtgtccagaaagagnaaaaagtataaggggtgaaatcttggccctttcaa

SEQ ID NO: 40852 - DNA, 71 bp, chicken (Gallus Gallus)
  misc_feature (36): n=a or c
cacatatggagtaaaagttctctgtggagatttttnttgctctgtgaccaatttctgtgcaacaggcactt

SEQ ID NO: 40853 - DNA, 71 bp, chicken (Gallus Gallus)
  misc_feature (36): n=c or t
gttagagacaggaaatctgtgggcaagtattctgtngcatgcctgtaaagtgatgtctacgttcagtatag

SEQ ID NO: 40854 - DNA, 71 bp, chicken (Gallus Gallus)
  misc_feature (36): n=c or t
gccttccctgcttgcagactaagggctgaggaaatngcattcttccctatgctgaagccattcgcgctact

SEQ ID NO: 40855 - DNA, 71 bp, chicken (Gallus Gallus)
  misc_feature (36): n=c or t
aagaacagaggaagcctgttgttcagcaaggctgangatgaaggtagcagccatccaaaataaagtgcagc

SEQ ID NO: 40856 - DNA, 71 bp, chicken (Gallus Gallus)
  misc_feature (36): n=a or g
aagaggttaagttgtaatctaatagcagcctagacntacttgagagatacctacaaagacagccctgccaa

SEQ ID NO: 40857 - DNA, 71 bp, chicken (Gallus Gallus)
  misc_feature (36): n=a or g
aaaagaggaccgggttgagttatctcaccatgggangaaaaaggcatgcacaatcagatatttaacactcc

SEQ ID NO: 40858 - DNA, 71 bp, chicken (Gallus Gallus)
  misc_feature (36): n=g or t
aaaagttggaggctttccttctggcttacagacagntgtatctctgatttctactggtttaatcactcagg

SEQ ID NO: 40859 - DNA, 71 bp, chicken (Gallus Gallus)
  misc_feature (36): n=c or t
attacttttccttctcatattctcaatgcctaatgnagagagaaactactttggagaagactaataaaaag

SEQ ID NO: 40860 - DNA, 71 bp, chicken (Gallus Gallus)
  misc_feature (36): n=c or t
tactggagctaggaggttcccagggtgattccacantgagcaggtaatgccccaccagagggaggatatca

SEQ ID NO: 40861 - DNA, 71 bp, chicken (Gallus Gallus)
  misc_feature (36): n=c or t
tcagacaatgtggctatagagtgcacatgtacttcngcatggcatttggatcagttcttccaggagataaa

SEQ ID NO: 40862 - DNA, 71 bp, chicken (Gallus Gallus)
  misc_feature (36): n=a or g
tttccaaaaggattttattatcttgtgatgcaaaantgctcctaatgtcttccatttatgtcacttattta

SEQ ID NO: 40863 - DNA, 71 bp, chicken (Gallus Gallus)
  misc_feature (36): n=a or g
tttttacataaaataattctctttgcggtgatttgnctgctcagttcaacaagtacgttcaccttcttcat

SEQ ID NO: 40864 - DNA, 71 bp, chicken (Gallus Gallus)
  misc_feature (36): n=a or g
gaggaaaagactttcaatagattctgtaaagggcantgagattggtaagcttatttaatgattggacagta

SEQ ID NO: 40865 - DNA, 71 bp, chicken (Gallus Gallus)
  misc_feature (36): n=a or g
attgttttttctctcccagcatctcatttttaggtnctgccatgccttcgattgagacatccagtctcagt

SEQ ID NO: 40866 - DNA, 71 bp, chicken (Gallus Gallus)
  misc_feature (36): n=a or g
agagagaatattaacctgtctcactactatggtccntgggtccccaccagacctttgggtgcaccctatgt

SEQ ID NO: 40867 - DNA, 71 bp, chicken (Gallus Gallus)
  misc_feature (36): n=c or t
gaagatgaacggaacaaagcttggtatttcataagnggtttacagaacgttaaggggaatattttgttcca

SEQ ID NO: 40868 - DNA, 71 bp, chicken (Gallus Gallus)
  misc_feature (36): n=a or g
gtggtacctgggagatactttccagttttcccacancctcttggtgagacagaaaatggccttttgcaaca

SEQ ID NO: 40869 - DNA, 71 bp, chicken (Gallus Gallus)
  misc_feature (36): n=a or g
aaaagttggagaggagtttaaggatgcagctgagcnaggtgagggtttatgacagacatagtgattttgtt

SEQ ID NO: 40870 - DNA, 71 bp, chicken (Gallus Gallus)
  misc_feature (36): n=c or t
acttaagccatacacacacctgtagtatctgagatngttgtagaaattgtagaatgtctgacgcaaatctg

SEQ ID NO: 40871 - DNA, 71 bp, chicken (Gallus Gallus)
  misc_feature (36): n=a or g
aaattccttaattgtaaaaaaatactaaaacctacnaataggataaacatgttaaagtgtctggttatttt

SEQ ID NO: 40872 - DNA, 71 bp, chicken (Gallus Gallus)
  misc_feature (36): n=c or t
cgatggactgcacaccagaaataatacttttcagancctgcattacctgcaagtgatgcattacaaaaaac

SEQ ID NO: 40873 - DNA, 71 bp, chicken (Gallus Gallus)
  misc_feature (36): n=a or c
aacataaaatggatcgtgccagtggtttaaaagaanagcccacagaatggctcagttagcaattgaaaagt

SEQ ID NO: 40874 - DNA, 71 bp, chicken (Gallus Gallus)
  misc_feature (36): n=c or t
acagtttctctcctttccttctatatcttacttcgnattttcttcgaggtgtggcagaaggggatatttct

SEQ ID NO: 40875 - DNA, 71 bp, chicken (Gallus Gallus)
  misc_feature (36): n=a or g
agggtagcgggagtctttttctgtgattaatatttntaatcatttaaaagttgatgaggacaaagaacacc

SEQ ID NO: 40876 - DNA, 71 bp, chicken (Gallus Gallus)
  misc_feature (36): n=c or t
aagctcacacagcacagtcttggttataaaacctangcctttaacttggtctcgcttgtttcctacaaggc

SEQ ID NO: 40877 - DNA, 71 bp, chicken (Gallus Gallus)
  misc_feature (36): n=g or t
taggaacaatatttctttgctgtaggacatcattantgcttgttgttttagctgccccatgcctagcagtt

SEQ ID NO: 40878 - DNA, 71 bp, chicken (Gallus Gallus)
  misc_feature (36): n=c or t
aaaaagaccaatccatgacagagttttctgttcccncattgctgtgcatgactgaaactgagatgggcaag

SEQ ID NO: 40879 - DNA, 71 bp, chicken (Gallus Gallus)
  misc_feature (36): n=c or t
attttgttctgctcttgattttgcagttagagcccngtacttcacattccagtgaactgcactgctcatgc

SEQ ID NO: 40880 - DNA, 71 bp, chicken (Gallus Gallus)
  misc_feature (36): n=a or g
gacctagatccaccaatccatgtatttcttctacanctaattttcattaaatcattccattaactccaatg

SEQ ID NO: 40881 - DNA, 71 bp, chicken (Gallus Gallus)
  misc_feature (36): n=c or t
tctatgaatcaggtgtgggacctgttccaccacttngaactctacagacttcagagggatagaatcaaata

SEQ ID NO: 40882 - DNA, 71 bp, chicken (Gallus Gallus)
  misc_feature (36): n=c or t
agtgattgccagtggaaaaaactgttgtaaaaatanaagactaaatgaccagaaagaaccagtatagctgc

SEQ ID NO: 40883 - DNA, 71 bp, chicken (Gallus Gallus)
  misc_feature (36): n=c or t
tagactttttataggctcttttgtcaggcagcgttnacaacctgtgtttggaccccatataagacgtgatg

SEQ ID NO: 40884 - DNA, 71 bp, chicken (Gallus Gallus)
  misc_feature (36): n=c or t
aaaatacattaaatcatgtttatatttacattatgngtctgtgtacatatacatagcatgtacattcacta

SEQ ID NO: 40885 - DNA, 71 bp, chicken (Gallus Gallus)
  misc_feature (36): n=a or g
ttcatgtcagcatgatggaatatttggagtgaacanattcactttattcacattttcaaatccctttaaac

SEQ ID NO: 40886 - DNA, 71 bp, chicken (Gallus Gallus)
  misc_feature (36): n=a or c
acacttttgtagtgtatcaaaaattgattttcctcncctataactttctagttttctacggaatcatggtt

SEQ ID NO: 40887 - DNA, 71 bp, chicken (Gallus Gallus)
  misc_feature (36): n=c or t
tctccttcataataatctttcttgttcaaaacttgnagtttgagtcttttttggtaacctgaacaatttac

SEQ ID NO: 40888 - DNA, 71 bp, chicken (Gallus Gallus)
  misc_feature (36): n=a or g
ttgttctttttctgaaaggaggattgcagtgcatgnatttatatcagtatagtatttaattcaccaactcc

SEQ ID NO: 40889 - DNA, 71 bp, chicken (Gallus Gallus)
  misc_feature (36): n=a or g
tgtttttctgcatgagcatctaaacattcactaccnatgataggatttccagagtatcttgaatgaattgg

SEQ ID NO: 40890 - DNA, 71 bp, chicken (Gallus Gallus)
  misc_feature (36): n=c or t
gttgtttatttgttgccttctcttgtgctatggggnagggaccttcatggttcatctcgacatttttcttt

SEQ ID NO: 40891 - DNA, 71 bp, chicken (Gallus Gallus)
  misc_feature (36): n=a or g
ttgcaataattgatttccttaaaacaaatggttgcntaatgcagctagctgctgggggggaaaggaaaaaa

SEQ ID NO: 40892 - DNA, 71 bp, chicken (Gallus Gallus)
  misc_feature (36): n=a or g
gaaactccttgtcgcaggatgttgaggaagccaacngtataaatgggttcaagaagggattacacaaattc

SEQ ID NO: 40893 - DNA, 71 bp, chicken (Gallus Gallus)
  misc_feature (36): n=c or t
ctatgtgtgtagttgagatactctgggatgaatccntgagattcacatagtggcagtgggagaactgctgc

SEQ ID NO: 40894 - DNA, 71 bp, chicken (Gallus Gallus)
  misc_feature (36): n=c or t
gtctgaatctttgatgatgagatgttaatagttccnggccttcttttaaacagttgagtgcaattgcaaga

SEQ ID NO: 40895 - DNA, 71 bp, chicken (Gallus Gallus)
  misc_feature (36): n=a or g
gtgcagtccaaaatggcaccattgcaaccaactggntaataagccaggccaaccagagcagtgacagactt

SEQ ID NO: 40896 - DNA, 71 bp, chicken (Gallus Gallus)
  misc_feature (36): n=c or t
gagggactttgtgagagctttttacgcaaagatttngctctaaaaaaggacgactgtttgctttgtaagga

SEQ ID NO: 40897 - DNA, 71 bp, chicken (Gallus Gallus)
  misc_feature (36): n=c or t
ggtataaaaggtaatatgagcttcaccttctgcagngttactcagaagggacatcagctaaaatacagaat

SEQ ID NO: 40898 - DNA, 71 bp, chicken (Gallus Gallus)
  misc_feature (36): n=c or t
aaatggaagttatgcctttcatttttcaagtatagngaagtttgagtgagttccaacgttcttgtctttaa

SEQ ID NO: 40899 - DNA, 71 bp, chicken (Gallus Gallus)
  misc_feature (36): n=a or g
gtaatagggccaatatgtgaaagctggaaaataagntgtctagctatgggcaggcgttatttacctcctgc

SEQ ID NO: 40900 - DNA, 71 bp, chicken (Gallus Gallus)
  misc_feature (36): n=c or t
gtggctatgccatatcatttggcctcagaaccgtanaacaggtcctggccctgttcagttttctagtcact

SEQ ID NO: 40901 - DNA, 71 bp, chicken (Gallus Gallus)
  misc_feature (36): n=g or t
acatattaattgagaagtgtggagaaaatcttaaancttaacatgtggaaaatatgtatattccccaagaa

SEQ ID NO: 40902 - DNA, 71 bp, chicken (Gallus Gallus)
  misc_feature (36): n=c or t
gttttatagtgagacattaaaaagtggttttaatgngcgctcagcatgcgtgggtactcacaatcggtgat

SEQ ID NO: 40903 - DNA, 71 bp, chicken (Gallus Gallus)
  misc_feature (36): n=a or g
cccaagcaatgcagtcgcacagccctgggtatcctntacagtcatcctgattgggattttgttttcccttc

SEQ ID NO: 40904 - DNA, 71 bp, chicken (Gallus Gallus)
  misc_feature (36): n=c or t
tgcaactctcatctcttctttcaggctcacatcccnttttcctttcatgttgtcctcatatgcctggagcc

SEQ ID NO: 40905 - DNA, 71 bp, chicken (Gallus Gallus)
  misc_feature (36): n=c or t
tcctgtgtaatcacctctaggctagggaaatgagantcccaatgtcagtcctgcttatctctgccttgctg

SEQ ID NO: 40906 - DNA, 71 bp, chicken (Gallus Gallus)
  misc_feature (36): n=a or c
agctgtgtggcaccgaggcgtgcattccctccatgnaagcagctcaatcagatcgctaaagacgtgggcat

SEQ ID NO: 40907 - DNA, 71 bp, chicken (Gallus Gallus)
  misc_feature (36): n=a or g
tgtgatggagagacccccattgcaggagtgaacacnctgtgagttcgcatttctaactgtcactgaaagtc

SEQ ID NO: 40908 - DNA, 71 bp, chicken (Gallus Gallus)
  misc_feature (36): n=c or t
catggctctggggacagacaggaacctgtggactangaggacactttggtgtacaggcatagtgcagcagc

SEQ ID NO: 40909 - DNA, 71 bp, chicken (Gallus Gallus)
  misc_feature (36): n=c or t
aaaaccaacaaaagctcagatgcacagaggagtcanagtgccttttctattaagaaacaagagcaacagta

SEQ ID NO: 40910 - DNA, 71 bp, chicken (Gallus Gallus)
  misc_feature (36): n=a or g
agtgagcacaaatggtgtttaataaattcagatccnttttgactcaagctgacaggctatctgttgaagtt

SEQ ID NO: 40911 - DNA, 71 bp, chicken (Gallus Gallus)
  misc_feature (36): n=c or t
ttgagtccaattttctgccaagaaaggcaggctgtnaggcagcactgcattgtgtaggagtaaaaattgaa

SEQ ID NO: 40912 - DNA, 71 bp, chicken (Gallus Gallus)
  misc_feature (36): n=a or g
tttgtctgtgacgtctttgaatttgtatgcttgcangattcgtgctttccatttacgggcaatttagtgct

SEQ ID NO: 40913 - DNA, 71 bp, chicken (Gallus Gallus)
  misc_feature (36): n=g or t
cagcaacaggactatctgcaaatagttctgtgattnttcattcacatgttatcatatgaccaggagcccta

SEQ ID NO: 40914 - DNA, 71 bp, chicken (Gallus Gallus)
  misc_feature (36): n=a or g
aggagccccaaatggtgcaaggacagtcctggagcncctctcagcagaggttctgctaaggtcctccacag

SEQ ID NO: 40915 - DNA, 71 bp, chicken (Gallus Gallus)
  misc_feature (36): n=g or t
ttgttgcttacactgctgacttggatcagaatctgnggtcatcttcacgtagttggaagggaagagacctg

SEQ ID NO: 40916 - DNA, 71 bp, chicken (Gallus Gallus)
  misc_feature (36): n=c or t
cattgcagcattgtgtaaatgcatttgacagactanggacaacatctaaaaatggtttattcttgctatta

SEQ ID NO: 40917 - DNA, 71 bp, chicken (Gallus Gallus)
  misc_feature (36): n=a or g
ttattcacagtatttagtgtagctgaagtgttgagngaggcttagcttttttttgctttttttttctttta

SEQ ID NO: 40918 - DNA, 71 bp, chicken (Gallus Gallus)
  misc_feature (36): n=a or g
gctgagtcttgtgaatgtgcttgtgttcccaggctntacatcactgtggatgaacctgatttggccatcac

SEQ ID NO: 40919 - DNA, 71 bp, chicken (Gallus Gallus)
  misc_feature (36): n=c or t
ttctttgtcttcttcagaaactgtttcaagctcccngaagacatatattcagtgatgaaaattacctgtgg

SEQ ID NO: 40920 - DNA, 71 bp, chicken (Gallus Gallus)
  misc_feature (36): n=c or t
agagcttcaaccacaccaaggaggcaaggtcacatnacttaaactatcccatgcatgtttgctagcagaag

SEQ ID NO: 40921 - DNA, 71 bp, chicken (Gallus Gallus)
  misc_feature (36): n=c or t
tccaagcacttgtgtatgtttgctgctttctagacngagagctctttcccaaatagacgtgtttgcattta

SEQ ID NO: 40922 - DNA, 71 bp, chicken (Gallus Gallus)
  misc_feature (36): n=g or t
gcaggcgggcgagtttgattactcagggtcacaggngagcatccctcagagagttggcaaacagaggcctc

SEQ ID NO: 40923 - DNA, 71 bp, chicken (Gallus Gallus)
  misc_feature (36): n=a or g
aagaactgcctgttttaacctcagaaatacggaccnagagtaaagcaacagctgatgccatcacagtcagt

SEQ ID NO: 40924 - DNA, 71 bp, chicken (Gallus Gallus)
  misc_feature (36): n=c or t
cacgatcactgttgccattgccaacattgccaacanaatctctatatccatcgccatcccatcgcaaccaa

SEQ ID NO: 40925 - DNA, 71 bp, chicken (Gallus Gallus)
  misc_feature (36): n=c or t
aagcacctcctccactccaaccactccaactactgngatccctcccgtgtcccggctgagtgtggccctgg

SEQ ID NO: 40926 - DNA, 71 bp, chicken (Gallus Gallus)
  misc_feature (36): n=a or c
tttaaaccaatagcagctatgtatgaactcacgctncctacagaagctggggagtaaaaatatctatgtca

SEQ ID NO: 40927 - DNA, 71 bp, chicken (Gallus Gallus)
  misc_feature (36): n=a or g
ggtgtgtgctgtggtctcggacaggagtgccttttngggaggttgtcagcatgcattagccatcgtggaaa

SEQ ID NO: 40928 - DNA, 71 bp, chicken (Gallus Gallus)
  misc_feature (36): n=c or t
acgggggagcagaggcacacacagtaagttcctcantgccttggacaatgcactgattttctctctgctgg

SEQ ID NO: 40929 - DNA, 71 bp, chicken (Gallus Gallus)
  misc_feature (36): n=c or t
gaaatcattggacttttggtatgttgtttgaattcnccatcagcaccctaaggtgctcacacaagaaatgg

SEQ ID NO: 40930 - DNA, 71 bp, chicken (Gallus Gallus)
  misc_feature (36): n=a or g
ccaaaataaaagcgggcagcgtggctgctcctatcntggtgggacacatgctctagaggcagcgtgggcag

SEQ ID NO: 40931 - DNA, 71 bp, chicken (Gallus Gallus)
  misc_feature (36): n=a or c
gtatgggcaattctatgccattaaatacaccagcanatgtggccacttcctgcagcataccagaattgtat

SEQ ID NO: 40932 - DNA, 71 bp, chicken (Gallus Gallus)
  misc_feature (36): n=a or g
gtgctgagggtttgtgccagctcataccatagggtnccaggagcacaagggcatgcagcttcagtagggga

SEQ ID NO: 40933 - DNA, 71 bp, chicken (Gallus Gallus)
  misc_feature (36): n=a or g
acaccaacctcatcgatcagtgtggcagcacccacnggaaagccaaaggctgtagagatggcatctacttt

SEQ ID NO: 40934 - DNA, 71 bp, chicken (Gallus Gallus)
  misc_feature (36): n=a or g
accatcccctgtgcagatgaagcccagataggtggngcagacaaatttactgcagggcagcttttctttct

SEQ ID NO: 40935 - DNA, 71 bp, chicken (Gallus Gallus)
  misc_feature (36): n=a or g
gttgagttatgacccatcttagcactggagagaaangattgctagttctaaagcaatcctccccagcctgc

SEQ ID NO: 40936 - DNA, 71 bp, chicken (Gallus Gallus)
  misc_feature (36): n=g or t
gaacagcactatataatatccaagttgggctcgganatcatttactctcagccttactctttcaaaatgct

SEQ ID NO: 40937 - DNA, 71 bp, chicken (Gallus Gallus)
  misc_feature (36): n=c or t
ttactgcagcctccatctccctgctgtgctggccantgatccaggtttgccagaactggaaatgcctttcc

SEQ ID NO: 40938 - DNA, 71 bp, chicken (Gallus Gallus)
  misc_feature (36): n=a or g
actgcccattggcacgcccaagctgggagcatttgnactcctgagccacggcttctcctgggaagtgctac

SEQ ID NO: 40939 - DNA, 71 bp, chicken (Gallus Gallus)
  misc_feature (36): n=a or g
gcaaatgtttgcatgcactgggggaaattcagctcntctcggcagcagtgagctcagagatcctctccctt

SEQ ID NO: 40940 - DNA, 71 bp, chicken (Gallus Gallus)
  misc_feature (36): n=g or t
cttctctccttcagccagcactatccaacattcacngggacccatcttctcaggggccaaataggctgagc

SEQ ID NO: 40941 - DNA, 71 bp, chicken (Gallus Gallus)
  misc_feature (36): n=a or g
tttaatatgttgactttctttctgggcaaagcatcngtcatgtgtgcatttttccatagtcccatcatgga

SEQ ID NO: 40942 - DNA, 71 bp, chicken (Gallus Gallus)
  misc_feature (36): n=c or t
cccaaagaaaagcggttttctccgctccgggtccgncgctctctggggcggggaaggggagccccgatccc

SEQ ID NO: 40943 - DNA, 71 bp, chicken (Gallus Gallus)
  misc_feature (36): n=a or g
aaaggtgtgaagagaaagcaaggactgattgcattnccttccttttggtgtcccttggtcaccatctggcc

SEQ ID NO: 40944 - DNA, 71 bp, chicken (Gallus Gallus)
  misc_feature (36): n=a or g
aattcaaatccctccttacaccagctgttttccccnaacacaccaactggttcattacagggccgctcacg

SEQ ID NO: 40945 - DNA, 71 bp, chicken (Gallus Gallus)
  misc_feature (36): n=c or t
cttcatgcctatgaaaactgctgatataatttcggnctggaaacccttcatcccaagcatctgagcagtaa

SEQ ID NO: 40946 - DNA, 71 bp, chicken (Gallus Gallus)
  misc_feature (36): n=c or t
ttgtggtggttttaatttttgatgcctgtgctgtgngttttcccctcgcgctccaaatctctgcaatgaaa

SEQ ID NO: 40947 - DNA, 71 bp, chicken (Gallus Gallus)
  misc_feature (36): n=a or g
tttctcataaggatgtggaaagggcaaatggtttcnagccttgcatagtggaaaaaattgtaatgtgtcac

SEQ ID NO: 40948 - DNA, 71 bp, chicken (Gallus Gallus)
  misc_feature (36): n=c or t
cagagctattaagtggccccagtgaagtgccagctngtcctcgtttgagggcaatgggttcgagccattaa

SEQ ID NO: 40949 - DNA, 71 bp, chicken (Gallus Gallus)
  misc_feature (36): n=a or c
atccctgtatttaactcctggagggacaacaggggntgcagcaaggagcctgacaaccctgcatgcccaag

SEQ ID NO: 40950 - DNA, 71 bp, chicken (Gallus Gallus)
  misc_feature (36): n=a or g
ctgtgataccccattgacttgagttgtgtcaccagngttgacccaaggagaactgccctggtgactgcaag

SEQ ID NO: 40951 - DNA, 71 bp, chicken (Gallus Gallus)
  misc_feature (36): n=a or g
tgttagacctttaaatcatggtaatagtcttcagcncaggaaaggtaacttggggacttgagttttggtgg

SEQ ID NO: 40952 - DNA, 71 bp, chicken (Gallus Gallus)
  misc_feature (36): n=a or g
ctggatttgcctggacccaagcacactgaatttggngaagctggagtttttcactggattctgagtcaggc

SEQ ID NO: 40953 - DNA, 71 bp, chicken (Gallus Gallus)
  misc_feature (36): n=g or t
ttctcatctgtacatgttcacttgtttaaagaaatnctgttattttgcctgttgttaaaaagttctgtctt

SEQ ID NO: 40954 - DNA, 71 bp, chicken (Gallus Gallus)
  misc_feature (36): n=c or t
tggactctggagctctgttctttctttgggctttcncttttaagctgtgttcagataacacacattttact

SEQ ID NO: 40955 - DNA, 71 bp, chicken (Gallus Gallus)
  misc_feature (36): n=g or t
agtatattgggtgggatgtggtcacaagactaaatnaatcttgaaaaaaacatttggttttgttacttcta

SEQ ID NO: 40956 - DNA, 71 bp, chicken (Gallus Gallus)
  misc_feature (36): n=a or g
tctctaacttctgtttcactgaaagcgaagtagtgntggacacagagattcaacacttcactaccttcttt

SEQ ID NO: 40957 - DNA, 71 bp, chicken (Gallus Gallus)
  misc_feature (36): n=c or t
atctgtgccttgttcctttacctagtgtttttttgnggtgttaacataacctgtccttctggggtgatgtc

SEQ ID NO: 40958 - DNA, 71 bp, chicken (Gallus Gallus)
  misc_feature (36): n=a or g
ctcattaatacatcaaaactgctagaaatccagtgngcaatttggctcatgagacaactgcctaaaaggac

SEQ ID NO: 40959 - DNA, 71 bp, chicken (Gallus Gallus)
  misc_feature (36): n=c or t
ctgaactaggcagctgagatgcaaaggggtattttncgatggcaagtctatacacagtatattttggttcc

SEQ ID NO: 40960 - DNA, 71 bp, chicken (Gallus Gallus)
  misc_feature (36): n=a or g
gcacttaatagctgcaaagcagttcttacagggagnaggtgcactccaactgcacagttatgtgtaggaca

SEQ ID NO: 40961 - DNA, 71 bp, chicken (Gallus Gallus)
  misc_feature (36): n=a or c
ggggcaatttgggcagcgttcatggggatcgccatnggaaattggcccaaactttgtccccttggagccat

SEQ ID NO: 40962 - DNA, 71 bp, chicken (Gallus Gallus)
  misc_feature (36): n=c or t
ggatgaattattttctggagatactgaccttccttnctttggtatggatgatactcagaagctcagtttgg

SEQ ID NO: 40963 - DNA, 71 bp, chicken (Gallus Gallus)
  misc_feature (36): n=c or t
gactcttatttacctttcctaaaacctggcaagaantaattgtagttatttgtagttattacactttttaa

SEQ ID NO: 40964 - DNA, 71 bp, chicken (Gallus Gallus)
  misc_feature (36): n=a or c
ttctctgtacagcagcttgcatagtgagatggcagntacaattggcagtgtatcatagagtcatgcagtgg

SEQ ID NO: 40965 - DNA, 71 bp, chicken (Gallus Gallus)
  misc_feature (36): n=a or g
gcttgcacaacctacacaaaagcttcttatgagctnagaagtgcttgcaagaagcaatcctctcctttgcc

SEQ ID NO: 40966 - DNA, 71 bp, chicken (Gallus Gallus)
  misc_feature (36): n=c or t
gtgtgtccatacttcagggtatgctgcggcattaangatgctgtcggaagaaattctctttaagtctacag

SEQ ID NO: 40967 - DNA, 71 bp, chicken (Gallus Gallus)
  misc_feature (36): n=a or g
agctgcctggatacagaggtatgtatgtggaaaagnagagcagaacacaaccttgagtacaggtgaaagca

SEQ ID NO: 40968 - DNA, 71 bp, chicken (Gallus Gallus)
  misc_feature (36): n=c or t
tccttaaggttctgtagagtttgatgagccttctcntctcacttgcttaacatctgcagtgtcagcatccc

SEQ ID NO: 40969 - DNA, 71 bp, chicken (Gallus Gallus)
  misc_feature (36): n=a or g
taaacaggaatgttacaccttatttgtatctgcacncaaagcctctgctcattctctgcctttaaacatga

SEQ ID NO: 40970 - DNA, 71 bp, chicken (Gallus Gallus)
  misc_feature (36): n=a or g
tgaaactgcatacgttgacatagcagtcacagtaanaaggtgtacctgcttttcaggaactgaaggtgcta

SEQ ID NO: 40971 - DNA, 71 bp, chicken (Gallus Gallus)
  misc_feature (36): n=c or t
aatcacagcccagtgtgaagaaaactaaagcattcnactgaaagaggcagagaaccctagcacagagaacc

SEQ ID NO: 40972 - DNA, 71 bp, chicken (Gallus Gallus)
  misc_feature (36): n=g or t
atgatcgtagacctccctgtttgcctcagcatttanagctcttaaccaaagtaacttcctgagctaataat

SEQ ID NO: 40973 - DNA, 71 bp, chicken (Gallus Gallus)
  misc_feature (36): n=a or g
agactgtgtgtggtgctcactttgcttggcttccangtaatttcacttggaggtgcattcaattcgtgctg

SEQ ID NO: 40974 - DNA, 71 bp, chicken (Gallus Gallus)
  misc_feature (36): n=a or g
ttggtaaggtctgaaagctaacatatgaaacagacnaggagacttgctcttagcacagcatgctgatgttg

SEQ ID NO: 40975 - DNA, 71 bp, chicken (Gallus Gallus)
  misc_feature (36): n=a or g
ttagaacaacagacatacattctggggcaaagaagncatggaaggaaagcacagagtgagaggaggggcac

SEQ ID NO: 40976 - DNA, 71 bp, chicken (Gallus Gallus)
  misc_feature (36): n=a or g
cttgtccaagaggaccaaggaaaaacagcagtaaantcagggagaaacatggtttggggaccattttgcat

SEQ ID NO: 40977 - DNA, 71 bp, chicken (Gallus Gallus)
  misc_feature (36): n=a or c
ccttctggagaaggtcactgagattttgggatatcnctgtgcaagaaactcaatttgcctggcaccttgtg

SEQ ID NO: 40978 - DNA, 71 bp, chicken (Gallus Gallus)
  misc_feature (36): n=g or t
ccatgattaatagaaataaaagtcaagcgttggctnatgtgagtgctgcaatactagaaacatgtacagca

SEQ ID NO: 40979 - DNA, 71 bp, chicken (Gallus Gallus)
  misc_feature (36): n=c or t
agctcctcttaaattgccatggctgttcttaaagcnctctgatatttaggaacaaaaacagtgcgtggaaa

SEQ ID NO: 40980 - DNA, 71 bp, chicken (Gallus Gallus)
  misc_feature (36): n=a or g
tttcggatgtacaaggtgagcacctgacacaaatgncaataaagcccttccttctcacacccgtcctttcg

SEQ ID NO: 40981 - DNA, 71 bp, chicken (Gallus Gallus)
  misc_feature (36): n=a or g
gcattcagccatagcacacacaggaatgggaaaggnatacgagcagagcatgctggaagagagagctttgc

SEQ ID NO: 40982 - DNA, 71 bp, chicken (Gallus Gallus)
  misc_feature (36): n=a or g
cccattcagagtcataaccaaattcttacgcgtacnaatcacttggaaagacaaggcccatttgtatgttt

SEQ ID NO: 40983 - DNA, 71 bp, chicken (Gallus Gallus)
  misc_feature (36): n=a or g
atgagttttcctgccctcaaacgaactcagtgggancctccagcataggaaagcacagtgcccagcccagc

SEQ ID NO: 40984 - DNA, 71 bp, chicken (Gallus Gallus)
  misc_feature (36): n=c or t
cttaaagcgtttatttatgtccagtgcctccattanaaggttagagtgtgccttggggacctgtaacagac

SEQ ID NO: 40985 - DNA, 71 bp, chicken (Gallus Gallus)
  misc_feature (36): n=c or t
tccgcatttcctattacttatattggttctaggcangggtaagcagcttagcagcagcagaagtaacaagc

SEQ ID NO: 40986 - DNA, 71 bp, chicken (Gallus Gallus)
  misc_feature (36): n=a or g
aggtcacgtaccctgcgaccccttggggatcaccantaacagaagaaaacctgcatagttcttcagtgccc

SEQ ID NO: 40987 - DNA, 71 bp, chicken (Gallus Gallus)
  misc_feature (36): n=a or g
cagtttgcattttcctctctgaacggatgtgtaagnagctccttaaggttgagagccttaagactctgttt

SEQ ID NO: 40988 - DNA, 71 bp, chicken (Gallus Gallus)
  misc_feature (36): n=a or g
aaacatcagcttgtggtagatttcttagaaacattntggctctgtacaggcaaacatgcatgaagggtttg

SEQ ID NO: 40989 - DNA, 71 bp, chicken (Gallus Gallus)
  misc_feature (36): n=a or g
ggtagaagagaggtctcacagcctcttggatagcantgagtcacatctgagattaagtccaggatcagtgt

SEQ ID NO: 40990 - DNA, 71 bp, chicken (Gallus Gallus)
  misc_feature (36): n=a or c
actttttggaggtgctaagcatgcagaaatgaacanaaattcttccagaagcacaaatgccaggaatatgt

SEQ ID NO: 40991 - DNA, 71 bp, chicken (Gallus Gallus)
  misc_feature (36): n=c or t
ctactcccttcaggcatatcccttacaaagcatggncttactggtataacactggattttcttgctgtcca

SEQ ID NO: 40992 - DNA, 71 bp, chicken (Gallus Gallus)
  misc_feature (36): n=a or g
ggggattcacgaaggaatgtttctcctctctgatgnctctgcctcgctgaactcttcaaggcctatgatgg

SEQ ID NO: 40993 - DNA, 71 bp, chicken (Gallus Gallus)
  misc_feature (36): n=a or c
gttcggtttcaatgagtaagcagaggtacagggctnttttacagtacaaggggagagcctgcttcactcat

SEQ ID NO: 40994 - DNA, 71 bp, chicken (Gallus Gallus)
  misc_feature (36): n=g or t
agaggaaatctgtcagaaggatacctgtcctcaccnaaagcatattaaactggtttaaaaccacccaaacc

SEQ ID NO: 40995 - DNA, 71 bp, chicken (Gallus Gallus)
  misc_feature (36): n=a or g
ccaacacgacagaatcctcctcttattctgcactgngtggcagttcctggtacatggaaagtcatacaggg

SEQ ID NO: 40996 - DNA, 71 bp, chicken (Gallus Gallus)
  misc_feature (36): n=a or g
gctgtaggatggtagaagagctgtctctgtgagcantgcactactggtttgttgctttgatgttttggggt

SEQ ID NO: 40997 - DNA, 71 bp, chicken (Gallus Gallus)
  misc_feature (36): n=c or t
ggcagaatctaattttgaaggtttcatggcaagtantgaggttttgtggccaattgtctaccaaaggctga

SEQ ID NO: 40998 - DNA, 71 bp, chicken (Gallus Gallus)
  misc_feature (36): n=c or t
gcacaggcagttttgagctatggaaagcagcttctnggggctttgagcacaatcccatgacccaaccatga

SEQ ID NO: 40999 - DNA, 71 bp, chicken (Gallus Gallus)
  misc_feature (36): n=a or g
ctgtactcacttatcttggtcccctactcaaggtanggtttgccagagtgttgaatctttcgtctttcaca

SEQ ID NO: 41000 - DNA, 71 bp, chicken (Gallus Gallus)
  misc_feature (36): n=c or t
ggaacccagcgaaacctctccccagccacatgagcnacggaggacatctcaagaacagcatgtgatccaga

SEQ ID NO: 41001 - DNA, 71 bp, chicken (Gallus Gallus)
  misc_feature (36): n=a or c
caggcattcaacaattaatttgctttgcagtggcanccttgagatggccgccgttgtaggaaaaagggaaa

SEQ ID NO: 41002 - DNA, 71 bp, chicken (Gallus Gallus)
  misc_feature (36): n=c or t
gttcaaggaaatgtcacgaaggagaggatctcccangtcagagagtgtgcagaagcaggtggcacaagagg

SEQ ID NO: 41003 - DNA, 71 bp, chicken (Gallus Gallus)
  misc_feature (36): n=c or t
tgcttacctgtgttaccttggttttccatctataanctcagtcctgtctggagacaggacattacactgtt

SEQ ID NO: 41004 - DNA, 71 bp, chicken (Gallus Gallus)
  misc_feature (36): n=a or g
gcgttgtgcacgctccccccgtccaaaattgcccantgacatgcaagtgtttctctttggggaagaagaaa

SEQ ID NO: 41005 - DNA, 71 bp, chicken (Gallus Gallus)
  misc_feature (36): n=a or g
agctggtcagacagagtccaagaagttttggattcnggaaacacagagcttctattggagaaggtcacagc

SEQ ID NO: 41006 - DNA, 71 bp, chicken (Gallus Gallus)
  misc_feature (36): n=c or t
taaatatcccttgcaaaatgtcttgaaagtggcaangaaggagattaaaagagctcttaccaagttattat

SEQ ID NO: 41007 - DNA, 71 bp, chicken (Gallus Gallus)
  misc_feature (36): n=c or t
ttattattctcttcataaggacctgatgtcccaccnctttgataaatatttcacttctggtcacttgaatc

SEQ ID NO: 41008 - DNA, 71 bp, chicken (Gallus Gallus)
  misc_feature (36): n=g or t
cagcttcactgttttcaatagcgtgcttctgctatnatgcaggacaccacaaaatgtggcagcaaaatctg

SEQ ID NO: 41009 - DNA, 71 bp, chicken (Gallus Gallus)
  misc_feature (36): n=a or g
catttcggaacagatgcaatggaattaatacaccantagctgtaggtagtaatgcagaacagaaagtgtta

SEQ ID NO: 41010 - DNA, 71 bp, chicken (Gallus Gallus)
  misc_feature (36): n=g or t
aatgacaaatattggcacattaatgtcacatcacancttctgtgactgtaccaagtctgagataatttgca

SEQ ID NO: 41011 - DNA, 71 bp, chicken (Gallus Gallus)
  misc_feature (36): n=c or t
atccaataaattcctctgtgggagaaagcatcatcncgctcttctggtttatacaagcttgaggatgacag

SEQ ID NO: 41012 - DNA, 71 bp, chicken (Gallus Gallus)
  misc_feature (36): n=c or t
gtaacatttgatgtgataactggaattaatcaccantcatctaaaagctaggcatgcagtattaaaaaaat

SEQ ID NO: 41013 - DNA, 71 bp, chicken (Gallus Gallus)
  misc_feature (36): n=c or t
tcaaaactgataaatggcagcatggccttctaaagntatgttctgcaaaacacgagttgttgcaactcaga

SEQ ID NO: 41014 - DNA, 71 bp, chicken (Gallus Gallus)
  misc_feature (36): n=c or t
tgtcttggtttctcctgcaaaagcatagaatgcaanatcaaagctcaaaccagggaagaaaagaccacgca

SEQ ID NO: 41015 - DNA, 71 bp, chicken (Gallus Gallus)
  misc_feature (36): n=c or t
tttctgctgtccaacatgaagttctgctactgcttntgaatagaattctaagttaatgaaagatacttggt

SEQ ID NO: 41016 - DNA, 71 bp, chicken (Gallus Gallus)
  misc_feature (36): n=a or g
gatcacttgcatggaacaccatggactgtggtcctncacaattgtaaggtcatcacaaatcatgcatcttg

SEQ ID NO: 41017 - DNA, 71 bp, chicken (Gallus Gallus)
  misc_feature (36): n=c or t
tgccagttcttaccatgagtcacagatgtaccctantggctcaacacctctcagcgttgattttgtctcta

SEQ ID NO: 41018 - DNA, 71 bp, chicken (Gallus Gallus)
  misc_feature (36): n=c or t
tctttttgtaagaaggcagtggttttcccaaattangatcttacagaaaaccgtaaactgagagcttcagc

SEQ ID NO: 41019 - DNA, 71 bp, chicken (Gallus Gallus)
  misc_feature (36): n=g or t
tagtgtcaaagaataggaaaatatcagattcatatnccctgtgctgtgggctggcaaaacacctcaccagt

SEQ ID NO: 41020 - DNA, 71 bp, chicken (Gallus Gallus)
  misc_feature (36): n=a or g
ctgtagcattagaatattctctaaagagagttatgnatcttatcttgcagcttcaacacctttaactggtt

SEQ ID NO: 41021 - DNA, 71 bp, chicken (Gallus Gallus)
  misc_feature (36): n=c or t
tcttaaatagagatttttaaagtactaagaaattcntacaattatccactctgactttacacattcatttg

SEQ ID NO: 41022 - DNA, 71 bp, chicken (Gallus Gallus)
  misc_feature (36): n=a or g
tccagcagttccatagtgatttgaattatcttggancatctcaaagggaacatggcctacacatgagttgc

SEQ ID NO: 41023 - DNA, 71 bp, chicken (Gallus Gallus)
  misc_feature (36): n=a or g
tcctacacctgccttgatattacaaatggtagtggntgtaaaatatggagactgcattcaaagatcctctg

SEQ ID NO: 41024 - DNA, 71 bp, chicken (Gallus Gallus)
  misc_feature (36): n=a or g
ttgcccgtatctccatctgcctgctgtatgaattcngcagaaagaaatagtgactgcattatgaacagatc

SEQ ID NO: 41025 - DNA, 71 bp, chicken (Gallus Gallus)
  misc_feature (36): n=c or t
gatgcactgaatggatgaagatacctaatgctttcnaatcctgctatcgaaagataatggcaccattgttt

SEQ ID NO: 41026 - DNA, 71 bp, chicken (Gallus Gallus)
  misc_feature (36): n=a or g
ttactttctattattctaaacatgtggttgtattgntactcactccagtgtcaccctgatatttttttgac

SEQ ID NO: 41027 - DNA, 71 bp, chicken (Gallus Gallus)
  misc_feature (36): n=a or g
agcaactccaaggccgccacatagctgctgaccatnaaaaatgaagtgcatatcaccagaatgatctcaaa

SEQ ID NO: 41028 - DNA, 71 bp, chicken (Gallus Gallus)
  misc_feature (36): n=a or g
acctgtgtttgtaaaagtgcatattgttaattgttngtccttttcttgattactggtacgtatatcagcaa

SEQ ID NO: 41029 - DNA, 71 bp, chicken (Gallus Gallus)
  misc_feature (36): n=c or t
aagctgtgagcagagtagctcaacaaccaaggtaancaaggactgctaagtatactgattggttctattct

SEQ ID NO: 41030 - DNA, 71 bp, chicken (Gallus Gallus)
  misc_feature (36): n=a or g
ctctggcaaagatccttgaaaaatatgctttgaggnatccagagagctttcatcagagcaaattgggagtg

SEQ ID NO: 41031 - DNA, 71 bp, chicken (Gallus Gallus)
  misc_feature (36): n=c or t
cagtttaaacaacaccatccggctaatttccagcanggaccaaactggaatgaaaatgacactgagggaag

SEQ ID NO: 41032 - DNA, 71 bp, chicken (Gallus Gallus)
  misc_feature (36): n=a or g
ttaaatatgcctcctctggggctccttcaaatatgngaaccagctggcaagctctatcccagctgcttatt

SEQ ID NO: 41033 - DNA, 71 bp, chicken (Gallus Gallus)
  misc_feature (36): n=c or t
gcgtcggtgggcattggtgggttgcttggagagtanattttattttcaaatgtcgttttcttcctaaagaa

SEQ ID NO: 41034 - DNA, 71 bp, chicken (Gallus Gallus)
  misc_feature (36): n=a or g
gaaccacatattgttcagaagttgcctacctctccnaagctcttggttccccgagatgctcagttgttatc

SEQ ID NO: 41035 - DNA, 71 bp, chicken (Gallus Gallus)
  misc_feature (36): n=c or t
ctaagaagttaagcattcagctagcacctaacatanacattcagcataattcttaggccaaccaaaagtgt

SEQ ID NO: 41036 - DNA, 71 bp, chicken (Gallus Gallus)
  misc_feature (36): n=a or g
agctctgcaactttgaggaaaatggattgaatactntgattttcaatgatttctaaatgcttctttttaac

SEQ ID NO: 41037 - DNA, 71 bp, chicken (Gallus Gallus)
  misc_feature (36): n=c or t
tgtttcaatagcccagaccatattaacatatgaatnatgttcagaatcttccactccaaaggctgctgaat

SEQ ID NO: 41038 - DNA, 71 bp, chicken (Gallus Gallus)
  misc_feature (36): n=c or t
cttataagccagctctgtggctatcatttcccaganttcagtgagactctatatgctattgttatatttta

SEQ ID NO: 41039 - DNA, 71 bp, chicken (Gallus Gallus)
  misc_feature (36): n=c or t
tttgaagcaggctcttagttaagaccagaaaagaanaatcgatacaattctgtgtttcctcttccaagatg

SEQ ID NO: 41040 - DNA, 71 bp, chicken (Gallus Gallus)
  misc_feature (36): n=a or g
ctcagccaccacggtgaagagctgatctattctcanttattaaattccagttcatggatgtgctcagctgc

SEQ ID NO: 41041 - DNA, 71 bp, chicken (Gallus Gallus)
  misc_feature (36): n=a or c
ccaatctacttgttagctctatttactttcccttgntgccttttctcccaacagccaaacaaaacaggaag

SEQ ID NO: 41042 - DNA, 71 bp, chicken (Gallus Gallus)
  misc_feature (36): n=g or t
ttttacaacacctccgtgcctcatctttgatttganccagcagaatggtttattgtaacatcaaatgatct

SEQ ID NO: 41043 - DNA, 71 bp, chicken (Gallus Gallus)
  misc_feature (36): n=g or t
tctaaaacacaaatagtggttgggaacaactgctcnacaacactgtttcgcagctgtggacaaatgggact

SEQ ID NO: 41044 - DNA, 71 bp, chicken (Gallus Gallus)
  misc_feature (36): n=a or g
ttccccttatgactggggtgctacgaactcaatgangcaagagaggcaagatcagccagggtagcgcagac

SEQ ID NO: 41045 - DNA, 71 bp, chicken (Gallus Gallus)
  misc_feature (36): n=g or t
gctgtctgaacacatctcagacactgattttatttncaatataacatttaccgcagaataaacacttaata

SEQ ID NO: 41046 - DNA, 71 bp, chicken (Gallus Gallus)
  misc_feature (36): n=a or g
aaaatattggtggtgttgaactgcattggttatatnaaagactaaacagtgtccagaagctgataggactt

SEQ ID NO: 41047 - DNA, 71 bp, chicken (Gallus Gallus)
  misc_feature (36): n=a or c
attcattgctcatcacagcacagtggaaggaagctnatgcagtgtccttcttctgtcatacctttaacata

SEQ ID NO: 41048 - DNA, 71 bp, chicken (Gallus Gallus)
  misc_feature (36): n=c or t
ggatctcagacttatgtaaatataataaatcagcanggaagcatttcagcttgcacacattacataaggaa

SEQ ID NO: 41049 - DNA, 71 bp, chicken (Gallus Gallus)
  misc_feature (36): n=a or g
ggtaagtaatttaaatgacgcttgtcggctcccaantagaagaaataaacgaacacaaaagagcaagattt

SEQ ID NO: 41050 - DNA, 71 bp, chicken (Gallus Gallus)
  misc_feature (36): n=a or g
gtgcctttgggggctctggttaaagatagaaaaacntagctttaatcatccagatgtgtgggcagcttcat

SEQ ID NO: 41051 - DNA, 71 bp, chicken (Gallus Gallus)
  misc_feature (36): n=c or t
taaatctgctctgcctccagtgaagccagctttttngtggtctctgctctgctcacatagagatcaattga

SEQ ID NO: 41052 - DNA, 71 bp, chicken (Gallus Gallus)
  misc_feature (36): n=a or g
agttcttctccttcccttgagtctgtgtgtgaaacngtagcacagaagcacgaggttctgttcatttcaag

SEQ ID NO: 41053 - DNA, 71 bp, chicken (Gallus Gallus)
  misc_feature (36): n=c or t
gatgctgaacttcagcagaggaaattatggcacaantcagtgtgagaagtgttggatgaaatggaatggaa

SEQ ID NO: 41054 - DNA, 71 bp, chicken (Gallus Gallus)
  misc_feature (36): n=c or t
ttcttcaggtaccgccacagccccgtcatctctgtngggaactcgaagttgcggtatttctttgcaacaat

SEQ ID NO: 41055 - DNA, 71 bp, chicken (Gallus Gallus)
  misc_feature (36): n=a or g
cggacaacgtgaacagggagctattctcaagttcangctactgcttgcctcgaatgatataactggaataa

SEQ ID NO: 41056 - DNA, 71 bp, chicken (Gallus Gallus)
  misc_feature (36): n=a or g
ttttgtttgcctttgcagcctggcatcccttcaacncccttgtttagctctgaaaccctgcgcctgcaggc

SEQ ID NO: 41057 - DNA, 71 bp, chicken (Gallus Gallus)
  misc_feature (36): n=c or t
aataagagaattcagcccataattctgattgcagangaaggttggacaattgtacagaatgaggccctctc

SEQ ID NO: 41058 - DNA, 71 bp, chicken (Gallus Gallus)
  misc_feature (36): n=c or t
gcaatgagcttccaggacttacacgcttctttcaangtgtgaaggatttcaaaccgtgggatctcactgcg

SEQ ID NO: 41059 - DNA, 71 bp, chicken (Gallus Gallus)
  misc_feature (36): n=a or c
agcagtgagaaaaccactgcatggactagggaagtntctctccactgcaactgaacatgaagtaggaaaac

SEQ ID NO: 41060 - DNA, 71 bp, chicken (Gallus Gallus)
  misc_feature (36): n=a or g
tttggatgcagcaggcactgggtcatctccttcagnactgctactggatgccaagcaaacgttttcattca

SEQ ID NO: 41061 - DNA, 71 bp, chicken (Gallus Gallus)
  misc_feature (36): n=c or t
agaactttcctcacccatctgatctcagactgtccnttcaaaagtcactccatcatcttttccatcagaag

SEQ ID NO: 41062 - DNA, 71 bp, chicken (Gallus Gallus)
  misc_feature (36): n=c or t
ttggtggtgggctgggagcccactgcttgctgccangcttaaagactcaacacaggtgaacaaggaagatg

SEQ ID NO: 41063 - DNA, 71 bp, chicken (Gallus Gallus)
  misc_feature (36): n=g or t
tctgcaaatctgaagtaaaggaggaatctcctcctntagcttaacaaacacactttagaacaagctcaggc

SEQ ID NO: 41064 - DNA, 71 bp, chicken (Gallus Gallus)
  misc_feature (36): n=a or g
ctaagtaatccaaacgttcatttaaacatgagaatngctttcctggagaaattagattttattccctaata

SEQ ID NO: 41065 - DNA, 71 bp, chicken (Gallus Gallus)
  misc_feature (36): n=c or t
gctggtcatcaaagccactgcgacaaaaagaaaagngccagcttgagcacagacagatctcaaactgggac

SEQ ID NO: 41066 - DNA, 71 bp, chicken (Gallus Gallus)
  misc_feature (36): n=a or g
gtgatgtgttatttccaccaccttttgcaccagggnagcatacaatgaatcatctgtcctgatgtttggaa

SEQ ID NO: 41067 - DNA, 71 bp, chicken (Gallus Gallus)
  misc_feature (36): n=c or t
tatattaatccattgacattcagggcttcttccttnagaagctcatccagctagatggcctacctatgtac

SEQ ID NO: 41068 - DNA, 71 bp, chicken (Gallus Gallus)
  misc_feature (36): n=c or t
ctggtccacgcacacactcaggggattcgattttgncagccattgagaacagcagaacagtgtacagtaca

SEQ ID NO: 41069 - DNA, 71 bp, chicken (Gallus Gallus)
  misc_feature (36): n=c or t
cacagctccatgccgacacagcgtggcatcatgctnccaaatctgccttgccttctcctcactgtggcact

SEQ ID NO: 41070 - DNA, 71 bp, chicken (Gallus Gallus)
  misc_feature (36): n=g or t
accaaatgaaacccatggacaggtgagaatagcatnaaatatagataagaaattagcaaggcttaatgtgc

SEQ ID NO: 41071 - DNA, 71 bp, chicken (Gallus Gallus)
  misc_feature (36): n=c or t
aagagcaccagtccctacaagcatttcacagcaacnagaggctcaaaacaaactggaaaggagacctggaa

SEQ ID NO: 41072 - DNA, 71 bp, chicken (Gallus Gallus)
  misc_feature (36): n=g or t
gataaagcaagatgattaaatctacaaacagatttntgatagggattggcacaattcttctaggaacaggg

SEQ ID NO: 41073 - DNA, 71 bp, chicken (Gallus Gallus)
  misc_feature (36): n=a or g
ctaaagcagttgtgtgctgatactgacctgagcacngggctgcagaaggcagcccaaaccaggaggcccac

SEQ ID NO: 41074 - DNA, 71 bp, chicken (Gallus Gallus)
  misc_feature (36): n=c or t
ccttcataatgtctttgaggcaagatttagggcaangtgactgcttgcataaggctgacccttggggagtg

SEQ ID NO: 41075 - DNA, 71 bp, chicken (Gallus Gallus)
  misc_feature (36): n=g or t
cagcagtattggtttcacttctgttcagtggaaggnctctttattgatccacataagactccgtgtttcat

SEQ ID NO: 41076 - DNA, 71 bp, chicken (Gallus Gallus)
  misc_feature (36): n=c or t
cttacagtgccattctgacttcaggtaatgttattnatgttttcatataggatagtgatggggtgaattaa

SEQ ID NO: 41077 - DNA, 71 bp, chicken (Gallus Gallus)
  misc_feature (36): n=a or g
ccacagaccagcatgatgccaacaagagccaccccnatcacaatcttggctgcaaagaaggtgcgagtttt

SEQ ID NO: 41078 - DNA, 71 bp, chicken (Gallus Gallus)
  misc_feature (36): n=a or c
gtcagtttcccagtctcgtagtttatgtaatcttgntgcagggagttcattttgaagagagaaggatgaca

SEQ ID NO: 41079 - DNA, 71 bp, chicken (Gallus Gallus)
  misc_feature (36): n=c or t
tcctttgatataaaagccaaggatttggcaatatgncttgaagaaaaccactggaaaagatgataaaaata

SEQ ID NO: 41080 - DNA, 71 bp, chicken (Gallus Gallus)
  misc_feature (36): n=c or t
caaatgattcctgcaacattaattcatttactgaanggttccacgctttgcttaacactgagggtattaaa

SEQ ID NO: 41081 - DNA, 71 bp, chicken (Gallus Gallus)
  misc_feature (36): n=c or t
agagatgttgatattggactgtcttggttttgggcnttctggctgtgtgagcgcttctggaggaacaaaaa

SEQ ID NO: 41082 - DNA, 71 bp, chicken (Gallus Gallus)
  misc_feature (36): n=a or g
ggtggtgaaacaatgaagacctaaatgctgaaatangcatactaatataatttatgtatacgtgttgtcag

SEQ ID NO: 41083 - DNA, 71 bp, chicken (Gallus Gallus)
  misc_feature (36): n=a or g
gtagcatgaaaaaagataccgttcatctgaaaatantttaatgtaacctattcattttgcatcactctcaa

SEQ ID NO: 41084 - DNA, 71 bp, chicken (Gallus Gallus)
  misc_feature (36): n=a or g
catctctgcattgtatatctgcatcacctgcacacntgcacacaggcagtggatttgttctgcaggcagat

SEQ ID NO: 41085 - DNA, 71 bp, chicken (Gallus Gallus)
  misc_feature (36): n=c or t
gcttcttgtggctctgggatttctggagttgaatgnagtgcctggatctttcttcatcagtgtccactctt

SEQ ID NO: 41086 - DNA, 71 bp, chicken (Gallus Gallus)
  misc_feature (36): n=a or g
acttcagtgaaaggtgtctgtgaaggaaaatgggantaaagctagaagaatttctgagatgtaaatgagga

SEQ ID NO: 41087 - DNA, 71 bp, chicken (Gallus Gallus)
  misc_feature (36): n=a or g
cattctttattgctattaatcaaaggagtttttggntgcattagaaatgtcatactctgttagtctacaga

SEQ ID NO: 41088 - DNA, 71 bp, chicken (Gallus Gallus)
  misc_feature (36): n=a or g
atgaccttacctttgttatttggaaaacaaaattanaagaggaaatgaagttccacaggaaacaaagttag

SEQ ID NO: 41089 - DNA, 71 bp, chicken (Gallus Gallus)
  misc_feature (36): n=a or c
tgttgtgacaaagtaatgtgaataaaaggagaaaantaggtctttaataactaaaggggagaagtttttga

SEQ ID NO: 41090 - DNA, 71 bp, chicken (Gallus Gallus)
  misc_feature (36): n=a or g
gaaagccaatgctgatgcaaaagaaccacttcagcnttttagaaatatctcaaaatagtaatgtcacttgc

SEQ ID NO: 41091 - DNA, 71 bp, chicken (Gallus Gallus)
  misc_feature (36): n=a or g
gctgaaaggagttccaggctgcccttctcagtgctngcttatgccaggttatcatggtgtgaaactaaggc

SEQ ID NO: 41092 - DNA, 71 bp, chicken (Gallus Gallus)
  misc_feature (36): n=c or t
caaagtgaaattttctccactgaattcgtctttttnatcaaaatgcctgtaggacctttgaaactcctctc

SEQ ID NO: 41093 - DNA, 71 bp, chicken (Gallus Gallus)
  misc_feature (36): n=a or g
gggtaaataatgtttcttttgcctgatctcttcgtntagttccttttgccattattgagcatttccacaag

SEQ ID NO: 41094 - DNA, 71 bp, chicken (Gallus Gallus)
  misc_feature (36): n=a or g
ccctgctcaaacactaagacttgctgtagggatggntaaccttagaccaatacaatcagggttctttggca

SEQ ID NO: 41095 - DNA, 71 bp, chicken (Gallus Gallus)
  misc_feature (36): n=a or g
tgactgtcactaaatagaagctgcattgagccaatnaatcttacaatggcctcattttgcttgtgatgaca

SEQ ID NO: 41096 - DNA, 71 bp, chicken (Gallus Gallus)
  misc_feature (36): n=c or t
agcagcagttgggtgagctcaaaggattaggaaacngtgtacttcaagtctagaggggattttcctatctg

SEQ ID NO: 41097 - DNA, 71 bp, chicken (Gallus Gallus)
  misc_feature (36): n=a or c
acaaaatgtacaggttatgtttgataattacattcnagcacggtcagacagcttgctcgtaccccagcact

SEQ ID NO: 41098 - DNA, 71 bp, chicken (Gallus Gallus)
  misc_feature (36): n=c or t
gtgatgaaggctcttatttctgattagatacttttngttcatattccagacctctgaccttcatttctgtc

SEQ ID NO: 41099 - DNA, 71 bp, chicken (Gallus Gallus)
  misc_feature (36): n=a or c
tgctgtgaaaactgcagtaacagcacaggaagcctncccagcgcccgtcacacgggacacagcctcgggtg

SEQ ID NO: 41100 - DNA, 71 bp, chicken (Gallus Gallus)
  misc_feature (36): n=c or t
ctgtgataactcaaaacctgatccttccacccaaancatgaagaggtacctgccttccaccttgcatttct

SEQ ID NO: 41101 - DNA, 71 bp, chicken (Gallus Gallus)
  misc_feature (36): n=c or t
gcgtgaatccattttacgcctcctccaacagcacgntctctagcagctaacgctgtcggttgtcactaaca

SEQ ID NO: 41102 - DNA, 71 bp, chicken (Gallus Gallus)
  misc_feature (36): n=a or g
gatcatcagaaaaaaatgttaacctccagatgtgcntggacccaatgttctctacctgccctccagcatgt

SEQ ID NO: 41103 - DNA, 71 bp, chicken (Gallus Gallus)
  misc_feature (36): n=c or t
ctttaaatacattttttgagcaattttcttcccccnttcagactttggttgctttatttgtcagctgataa

SEQ ID NO: 41104 - DNA, 71 bp, chicken (Gallus Gallus)
  misc_feature (36): n=a or g
gaatcaaggggattggaagttactgaggcaaagacncatacgcctgggaaagtatgctagaacagacatca

SEQ ID NO: 41105 - DNA, 71 bp, chicken (Gallus Gallus)
  misc_feature (36): n=g or t
gtaatggaaagctatacaatttgctcctgaaatgcngtttgaagtgattgataaagctttagtctgtctga

SEQ ID NO: 41106 - DNA, 71 bp, chicken (Gallus Gallus)
  misc_feature (36): n=c or t
caacttagagtaaattacaagtaactgcagaaagantgaatagaaaagctgaagtaactgaaggtgtagta

SEQ ID NO: 41107 - DNA, 71 bp, chicken (Gallus Gallus)
  misc_feature (36): n=g or t
atttctgccttcgtacacaatgatctttgaaaactncaacaaatttgctttttgaagtttcgtataaatca

SEQ ID NO: 41108 - DNA, 71 bp, chicken (Gallus Gallus)
  misc_feature (36): n=a or g
tctaaggggaaaggatttaaggtaagaacatcaatnctttcctatattagatgcatcactaaagtatggaa

SEQ ID NO: 41109 - DNA, 71 bp, chicken (Gallus Gallus)
  misc_feature (36): n=g or t
tttattggtgagagccaggcagcctaggagtgagcngtggttaaagggattagtttcatggaaatttgttt

SEQ ID NO: 41110 - DNA, 71 bp, chicken (Gallus Gallus)
  misc_feature (36): n=a or g
gaccctaagggccatccttccaaaacaagaatcacntgggatagttacccattcatgcagtagggtttggg

SEQ ID NO: 41111 - DNA, 71 bp, chicken (Gallus Gallus)
  misc_feature (36): n=c or t
gctgctaagtagttgtacttaaatcaactggagtantcatataagaagcaactactaaaatcagtaaaaga

SEQ ID NO: 41112 - DNA, 71 bp, chicken (Gallus Gallus)
  misc_feature (36): n=c or t
ccagtataaagctcatgtagttatcaatgaatactncattgttagcgtatttgcaaatgctcccaagcctt

SEQ ID NO: 41113 - DNA, 71 bp, chicken (Gallus Gallus)
  misc_feature (36): n=c or t
cagatgagtaaatttgacaaaaatctaattaatcanaaacaatgataattgtgtcttgcagaagaaatgct

SEQ ID NO: 41114 - DNA, 71 bp, chicken (Gallus Gallus)
  misc_feature (36): n=a or g
tacagtagtaatttttccagtggcaagcgttacatngtgcatttgcactgtaatgaactttctgctgtacc

SEQ ID NO: 41115 - DNA, 71 bp, chicken (Gallus Gallus)
  misc_feature (36): n=c or t
tcaaactttatcttctactgcccctcatcatcgcanggtgaaaatactctcctgaaaataggagaaatgag

SEQ ID NO: 41116 - DNA, 71 bp, chicken (Gallus Gallus)
  misc_feature (36): n=a or c
gccactgtgtgctcttgtgcagctaaataaaataanctaatacctgctgtattgtcaggatctcacacaca

SEQ ID NO: 41117 - DNA, 71 bp, chicken (Gallus Gallus)
  misc_feature (36): n=a or g
gataatatgaaatgaatgttaaacaaaattcagtancagattatatactgcaagtgtaaatcaagtaattt

SEQ ID NO: 41118 - DNA, 71 bp, chicken (Gallus Gallus)
  misc_feature (36): n=a or g
tcatataatattaatattgtaaaagctacaaatacngccttttgctttcttctatccccctttcctatgtc

SEQ ID NO: 41119 - DNA, 71 bp, chicken (Gallus Gallus)
  misc_feature (36): n=c or t
gccaaaagaacccaaaggcagcctgttaattgctcnagctgggacattagcaacagcagggcctatcttca

SEQ ID NO: 41120 - DNA, 71 bp, chicken (Gallus Gallus)
  misc_feature (36): n=a or g
agaggggagagagtttcagtgagcaatgtagctctntcattttggaaacagaggatttctgagaacagaga

SEQ ID NO: 41121 - DNA, 71 bp, chicken (Gallus Gallus)
  misc_feature (36): n=c or t
ctttttattagtactcctatgtttgtgatgctcagnttgtgctctgtttaaaaacacacagcttccttctg

SEQ ID NO: 41122 - DNA, 71 bp, chicken (Gallus Gallus)
  misc_feature (36): n=a or g
tggtgatggtattctgaaactgcatccctaatggcnagaaaacacggtctgttctgtcactttgatggatg

SEQ ID NO: 41123 - DNA, 71 bp, chicken (Gallus Gallus)
  misc_feature (36): n=c or t
tttaggaaatatcactgattcctgtgagcataccangaaaggaagctatcctgcagctcataataaacact

SEQ ID NO: 41124 - DNA, 71 bp, chicken (Gallus Gallus)
  misc_feature (36): n=c or t
atatagctgaggcacagaggtaaatgtctatccacntggctgcctgtcccatgatctctctggcaaggcat

SEQ ID NO: 41125 - DNA, 71 bp, chicken (Gallus Gallus)
  misc_feature (36): n=a or g
ttccacagtatcggaaaaaagtcatatggacaaacntcctatgtaaagcattgttaagagcctgggagatg

SEQ ID NO: 41126 - DNA, 71 bp, chicken (Gallus Gallus)
  misc_feature (36): n=c or t
ggttcagtttgctttcatagcaaggatgctgctctnatcttgcagctatggggaacccagctgtcctacaa

SEQ ID NO: 41127 - DNA, 71 bp, chicken (Gallus Gallus)
  misc_feature (36): n=a or g
taaaagtgtttgaatgttatttctaaaaacctcatngccaaaccagtacggtagctctgccttagcacaca

SEQ ID NO: 41128 - DNA, 71 bp, chicken (Gallus Gallus)
  misc_feature (36): n=g or t
atatgtatcagtcacagaaattgggtttctgtcctncaaatgcaagatctttataatatccatcacattaa

SEQ ID NO: 41129 - DNA, 71 bp, chicken (Gallus Gallus)
  misc_feature (36): n=a or g
acattttcactgtttcagcaagatccctgaaattcnaggctgatcaataaatgaatctacaacttcagggg

SEQ ID NO: 41130 - DNA, 71 bp, chicken (Gallus Gallus)
  misc_feature (36): n=a or g
gatggtctcagcacattgctgcactgagcagccgcncaagacaatgctctgacttcagcagctgaggtagg

SEQ ID NO: 41131 - DNA, 71 bp, chicken (Gallus Gallus)
  misc_feature (36): n=c or t
atcaaagctgtattcacattaccgctccatattcangttacccctccagttccagcattcacgatgctctg

SEQ ID NO: 41132 - DNA, 71 bp, chicken (Gallus Gallus)
  misc_feature (36): n=c or t
aatgtcttgtgttacttcccagccaagagcaaaggncttgtcaagaaattaagagatcttttttctactaa

SEQ ID NO: 41133 - DNA, 71 bp, chicken (Gallus Gallus)
  misc_feature (36): n=a or g
tacattctcagtatcaagaatttaaaactgcctaantttggatttcaaaaggttgtagactgcctggaatc

SEQ ID NO: 41134 - DNA, 71 bp, chicken (Gallus Gallus)
  misc_feature (36): n=c or t
tgaagtactatagttatcagaagtcctatctaaatncagattaacttttatatgtagatcaagctaaatgc

SEQ ID NO: 41135 - DNA, 71 bp, chicken (Gallus Gallus)
  misc_feature (36): n=c or t
acaggtacagtgctgggcagaccaagtactttgctnccaaagctggcataggctttgaaatagagtgtcag

SEQ ID NO: 41136 - DNA, 71 bp, chicken (Gallus Gallus)
  misc_feature (36): n=c or t
taataaggttcctgttagactctgtccctttttttntctttcatgttctgaaataatctgtagggatgaga

SEQ ID NO: 41137 - DNA, 71 bp, chicken (Gallus Gallus)
  misc_feature (36): n=a or g
ggaaattctccctttttctcctttcaaacttttcanttttggaaatggttcagggttcaaattagaaattt

SEQ ID NO: 41138 - DNA, 71 bp, chicken (Gallus Gallus)
  misc_feature (36): n=g or t
ggcagattctacgtagctgctgcagatagactaggngctgcttagtagtagataatgagaaaaagtaaact

SEQ ID NO: 41139 - DNA, 71 bp, chicken (Gallus Gallus)
  misc_feature (36): n=c or t
gagtgacttcctccttaatccaaagactgagatgtngaggctgactcaaaatgctgtataaactagaagat

SEQ ID NO: 41140 - DNA, 71 bp, chicken (Gallus Gallus)
  misc_feature (36): n=a or g
ggtgtatttttaatttgcttgagatcacacactttnacataaaaccacaaaaaggatcaattccatggctg

SEQ ID NO: 41141 - DNA, 71 bp, chicken (Gallus Gallus)
  misc_feature (36): n=c or t
ttcacaaattggttcatttccacctggttattatcngacggctaaaccataagcaatcaggatattttgat

SEQ ID NO: 41142 - DNA, 71 bp, chicken (Gallus Gallus)
  misc_feature (36): n=c or t
tgaacggcaaatggaaaaatgtttacgtgccttgcngctgttactacctacacggtggcagtaagtgactt

SEQ ID NO: 41143 - DNA, 71 bp, chicken (Gallus Gallus)
  misc_feature (36): n=a or g
ggaagggggcattgaccacaatatatcaaagggaantcactgctgattgcgaaacctgggctcatttttcc

SEQ ID NO: 41144 - DNA, 71 bp, chicken (Gallus Gallus)
  misc_feature (36): n=g or t
aaatggctttgactcacgttgtaatgttctccaagngcttaaaataaaactagttttcacagtcgtgtttc

SEQ ID NO: 41145 - DNA, 71 bp, chicken (Gallus Gallus)
  misc_feature (36): n=c or t
ccagtgccttgccttgttcacagcctggatttcctncgtaactgtggtctggtgtctgtaccaaagttacc

SEQ ID NO: 41146 - DNA, 71 bp, chicken (Gallus Gallus)
  misc_feature (36): n=a or g
agctcaagaaagcatgctgaagagcacctgaggtgnaagccccgatgacaggaatgcagggaattgtactt

SEQ ID NO: 41147 - DNA, 71 bp, chicken (Gallus Gallus)
  misc_feature (36): n=c or t
agacaaagcccagttttcctttgtcgtgaacttgancatacaagctttggagctgaggaacaaggtacttt

SEQ ID NO: 41148 - DNA, 71 bp, chicken (Gallus Gallus)
  misc_feature (36): n=a or g
cttgctttgtgaattctgttgcagctgaggtctgtntctgtagacctgaatgttgatccttctcttcaaat

SEQ ID NO: 41149 - DNA, 71 bp, chicken (Gallus Gallus)
  misc_feature (36): n=a or g
acttccacaaaaacctctggcttgcattacagtaangggtagtgaggccttggaactgctgcccagagaag

SEQ ID NO: 41150 - DNA, 71 bp, chicken (Gallus Gallus)
  misc_feature (36): n=c or t
gttctccttgtaatttgtggagcactgtgtatatcnagctactgcctgcaaagcaggaggtgttctcggct

SEQ ID NO: 41151 - DNA, 71 bp, chicken (Gallus Gallus)
  misc_feature (36): n=a or g
taaaagcaggaattccaatgctcttttgatacccantgatgccctcctgctggcatcgctgtactttggca

SEQ ID NO: 41152 - DNA, 71 bp, chicken (Gallus Gallus)
  misc_feature (36): n=a or g
tttgagatgctgtcaggcctgttcacaggaggtacnggttgctgagtggtcgtgtgctgaaggtggatgtg

SEQ ID NO: 41153 - DNA, 71 bp, chicken (Gallus Gallus)
  misc_feature (36): n=a or g
ctgtggctataaggctgtaaaactgaaaaacagganagttattgccttctactaccatagctccaaggcaa

SEQ ID NO: 41154 - DNA, 71 bp, chicken (Gallus Gallus)
  misc_feature (36): n=c or t
caaggcaggtttgtcaagtgtttcccagagtgcccnaaggctctgtccagacactggccttggcaggaggt

SEQ ID NO: 41155 - DNA, 71 bp, chicken (Gallus Gallus)
  misc_feature (36): n=c or t
cactcttctgtcctataaccttgaacctatgaaaangtacaccagctgtatttcatgttttatcagttaag

SEQ ID NO: 41156 - DNA, 71 bp, chicken (Gallus Gallus)
  misc_feature (36): n=c or t
cttttgtgactgcttccattactctgtaggtatccnaaaaacatggcaatggcaccatacagcagggagtt

SEQ ID NO: 41157 - DNA, 71 bp, chicken (Gallus Gallus)
  misc_feature (36): n=a or g
ctttcgctctgcaaagcaaggattgtggttagttantgagattaattgctctggcaccaaacttggcacga

SEQ ID NO: 41158 - DNA, 71 bp, chicken (Gallus Gallus)
  misc_feature (36): n=a or g
tttttagatgttagaaaccccttaaagcaccttaangcttactgcattatgtgtttaaaagaccctgacac

SEQ ID NO: 41159 - DNA, 71 bp, chicken (Gallus Gallus)
  misc_feature (36): n=c or t
agcattttgttgatatctgaaagctcactgcaaccngctttccatgtggtacgtgtatttgtggtccctgc

SEQ ID NO: 41160 - DNA, 71 bp, chicken (Gallus Gallus)
  misc_feature (36): n=a or g
agttgcctctttaactcccaggactgttcaaggacnaacatactaatgactatgaaggaactgaacgctgc

SEQ ID NO: 41161 - DNA, 71 bp, chicken (Gallus Gallus)
  misc_feature (36): n=c or t
agcaactattttcaagtgcagtttgcttccattttncctagcaatttctcacttgagaagccctgaacacc

SEQ ID NO: 41162 - DNA, 71 bp, chicken (Gallus Gallus)
  misc_feature (36): n=a or g
caaccactgcaattagagattacagagaaaaagacngaaggagggcttctacggctggaaaacttcatgca

SEQ ID NO: 41163 - DNA, 71 bp, chicken (Gallus Gallus)
  misc_feature (36): n=c or t
acgtggctctaacctctgttccaccttcaacctgtncaatgcagggcaattcttacattcctcgtatttac

SEQ ID NO: 41164 - DNA, 71 bp, chicken (Gallus Gallus)
  misc_feature (36): n=c or t
aaacaagaggacaaacgtgtgcaataccttcactgntcatacttctggacaattgttttcaacccagaggg

SEQ ID NO: 41165 - DNA, 71 bp, chicken (Gallus Gallus)
  misc_feature (36): n=a or g
aggaacaagctggaaatttcccttcccacgttcagncttagtagcgacattgttgggcacctccactgttc

SEQ ID NO: 41166 - DNA, 71 bp, chicken (Gallus Gallus)
  misc_feature (36): n=a or g
caaagcccaggatagctgcagtaatcaacacttggncatttaaactctgccaaaaatcatcattagttatt

SEQ ID NO: 41167 - DNA, 71 bp, chicken (Gallus Gallus)
  misc_feature (36): n=a or g
cagggaggaggtacagcagataaatgccagcaaagntacaggtatagatctcagtggagtgcaaatagctc

SEQ ID NO: 41168 - DNA, 71 bp, chicken (Gallus Gallus)
  misc_feature (36): n=g or t
ccccccagtcccatggagtcacctagctaaatcaantgtgtgaattgtgctaactgcatccacttgcctga

SEQ ID NO: 41169 - DNA, 71 bp, chicken (Gallus Gallus)
  misc_feature (36): n=c or t
ggatggggaaaacactgtagtgcctgaacaaaccangagaacatttatcttcatttttatttttgcttcat

SEQ ID NO: 41170 - DNA, 71 bp, chicken (Gallus Gallus)
  misc_feature (36): n=a or c
ggagtgcaaagaacaaacctccacgggacacctcanagcagagagcttaaatccactcctgacctatttct

SEQ ID NO: 41171 - DNA, 71 bp, chicken (Gallus Gallus)
  misc_feature (36): n=c or t
atgactcctctgaagccacgggaaagatgacctggngataaaagtatggatgcctacagagaaacgcagat

SEQ ID NO: 41172 - DNA, 71 bp, chicken (Gallus Gallus)
  misc_feature (36): n=a or c
ctttctaacccaaggcatcctatcgttctgtcacanacaaggatcatcgggcccaactcccggctctgcac

SEQ ID NO: 41173 - DNA, 71 bp, chicken (Gallus Gallus)
  misc_feature (36): n=c or t
ttcaagcacagggttgcatgggggaagaagtcaggnctgcagtcatgctccagctacaaggcttacttggg

SEQ ID NO: 41174 - DNA, 71 bp, chicken (Gallus Gallus)
  misc_feature (36): n=a or g
gatatggacttaaagtggctaacggtgggacacacncagcttttcaactctggtaattccttcttcagacg

SEQ ID NO: 41175 - DNA, 71 bp, chicken (Gallus Gallus)
  misc_feature (36): n=c or t
ttatgaatcattttctatcctctgaagtgcaaatgnggactcctttgagatggaaaattgtagattgggaa

SEQ ID NO: 41176 - DNA, 71 bp, chicken (Gallus Gallus)
  misc_feature (36): n=c or t
gagaaatgatcaactttgtcagacctgaaaagctangcactgaaaactgtaattgcgcaagagaaaagatg

SEQ ID NO: 41177 - DNA, 71 bp, chicken (Gallus Gallus)
  misc_feature (36): n=a or g
atgccggggaaggggctaagaatgagtcagtgactncaacgggagaaatcagctcttacccttccttgagc

SEQ ID NO: 41178 - DNA, 71 bp, chicken (Gallus Gallus)
  misc_feature (36): n=c or t
ctgggaagccgatgaatcaaacccatatgtggactngaaaagggctaccgcaaacacgaatgcatacaatt

SEQ ID NO: 41179 - DNA, 71 bp, chicken (Gallus Gallus)
  misc_feature (36): n=a or c
tttgtcagaagcactgaagaggaggttgtatggggngtttccttggaatatctggaagcattcaacaaaaa

SEQ ID NO: 41180 - DNA, 71 bp, chicken (Gallus Gallus)
  misc_feature (36): n=c or t
gtcagtgcaaataagctcagcgcctggcaagcattnggatgctaactatggcaagtactgtggctgtgctg

SEQ ID NO: 41181 - DNA, 71 bp, chicken (Gallus Gallus)
  misc_feature (36): n=a or g
tggaacaggtgggaagaaacaaaaaaggagggaggntgccttgtgaagctgtgtatttacctttgctctcc

SEQ ID NO: 41182 - DNA, 71 bp, chicken (Gallus Gallus)
  misc_feature (36): n=a or g
aactgttaattcatacagctgcatgtttgtaggagncatgagaatcaggggactcgcttcctactagattt

SEQ ID NO: 41183 - DNA, 71 bp, chicken (Gallus Gallus)
  misc_feature (36): n=a or c
ttagcattacttctctcttagaaatttatgtctgtnctcagtcatggcaatactgatatttgctcaggagg

SEQ ID NO: 41184 - DNA, 71 bp, chicken (Gallus Gallus)
  misc_feature (36): n=a or g
tttcttataaataatgttcaagaagtgtgctatgtncaatatagcatatgcaatatagcatattgctagag

SEQ ID NO: 41185 - DNA, 71 bp, chicken (Gallus Gallus)
  misc_feature (36): n=a or g
aaattcctggctgtaccatgccagtctggcaaatanccagtatgagtggctcagaaaaacactaggaaata

SEQ ID NO: 41186 - DNA, 71 bp, chicken (Gallus Gallus)
  misc_feature (36): n=a or g
cacatctgatttggctaagaacaccacgcaatacantacaaataatgctaacaggtttttgttgggttttt

SEQ ID NO: 41187 - DNA, 71 bp, chicken (Gallus Gallus)
  misc_feature (36): n=a or g
ccctacataactattgaattaggaacataaactaantatagcacttcttttagtcctcttgagcatgtatt

SEQ ID NO: 41188 - DNA, 71 bp, chicken (Gallus Gallus)
  misc_feature (36): n=a or g
gctttttgtcaccgataaccatgataatttatttcntaggcacctgtgcggaacccagagcagtttaaagc

SEQ ID NO: 41189 - DNA, 71 bp, chicken (Gallus Gallus)
  misc_feature (36): n=a or g
ggttaatggggaatgtagcagcaaagaggaataacntgctcagaaattcaggataagagcagaagctgggt

SEQ ID NO: 41190 - DNA, 71 bp, chicken (Gallus Gallus)
  misc_feature (36): n=g or t
tactgtcatttgtaattatactttcagaaaggaatntaatcccagcttggttaaatcaatatatttaagtg

SEQ ID NO: 41191 - DNA, 71 bp, chicken (Gallus Gallus)
  misc_feature (36): n=a or g
atatatgtattttttgctttgtatgctgtttgattntcttcacctgatcttcatctttttgaagcatcttg

SEQ ID NO: 41192 - DNA, 71 bp, chicken (Gallus Gallus)
  misc_feature (36): n=a or g
tcctgaagggaagaaaatccagagagattaatagtntgaataaaaaatgccataacgagcaaacatgtatg

SEQ ID NO: 41193 - DNA, 71 bp, chicken (Gallus Gallus)
  misc_feature (36): n=a or g
gatcctggaactgcttctcttcatattgttctgatngaggttgctgcctaatggaaagcaagggccaaata

SEQ ID NO: 41194 - DNA, 71 bp, chicken (Gallus Gallus)
  misc_feature (36): n=a or g
atgaaatttcatcttactcttttctcaccctttgcntaataggaaggtattcatggtgcatttggaagaag

SEQ ID NO: 41195 - DNA, 71 bp, chicken (Gallus Gallus)
  misc_feature (36): n=a or g
ggccactgtgagcacagacaccaagcacagagaacnctccatgccaagcacatagtagaaatgttaaattc

SEQ ID NO: 41196 - DNA, 71 bp, chicken (Gallus Gallus)
  misc_feature (36): n=c or t
acatgcatgagataaaacaacatggatgaaatccantgaaaagccctaaattttgcataagcaccacagtg

SEQ ID NO: 41197 - DNA, 71 bp, chicken (Gallus Gallus)
  misc_feature (36): n=a or g
aatcacgaaacactcccgactccgcatctctgtganttacctcaaccctgcagctattggaaatccagttc

SEQ ID NO: 41198 - DNA, 71 bp, chicken (Gallus Gallus)
  misc_feature (36): n=a or g
agaacacctattacagtatggcaactaggaaaaatncaaagcaacaaattgttggaaactacctcttgtcc

SEQ ID NO: 41199 - DNA, 71 bp, chicken (Gallus Gallus)
  misc_feature (36): n=g or t
taaatgatggcaataatcagtgtgaaaccaagaagncttccagatgagtgtgtttggggctatctgggaag

SEQ ID NO: 41200 - DNA, 71 bp, chicken (Gallus Gallus)
  misc_feature (36): n=a or c
aaactgcacatttgctttttaggtcaacattttcanagtagtgatttgcagtactcatcctgagacagttt

SEQ ID NO: 41201 - DNA, 71 bp, chicken (Gallus Gallus)
  misc_feature (36): n=a or g
agaggaaaataatagaaggattagcgaagcaaagtnggaagtagaagtgaactcaaagaacccgaaggtgt

SEQ ID NO: 41202 - DNA, 71 bp, chicken (Gallus Gallus)
  misc_feature (36): n=c or t
ttgctgctttcctacctggcctaaggaaagttcttnagactagaaagaggcttgtcctagacttctctggg

SEQ ID NO: 41203 - DNA, 71 bp, chicken (Gallus Gallus)
  misc_feature (36): n=c or t
cagatacatgagtgagccaagaagcacactcaagangggctaatggacccagaaaaagtaagatgactggg

SEQ ID NO: 41204 - DNA, 71 bp, chicken (Gallus Gallus)
  misc_feature (36): n=c or t
aacctttcttgtgcttcagtcaaaacacaaatatangcgcagttaaatggcacaaacaaacagaagacaaa

SEQ ID NO: 41205 - DNA, 71 bp, chicken (Gallus Gallus)
  misc_feature (36): n=c or t
aatatttgagatttacctacttgggtttcagatcantacaggtaaataaactaaaagccaaaaaaaaaaaa

SEQ ID NO: 41206 - DNA, 71 bp, chicken (Gallus Gallus)
  misc_feature (36): n=c or t
gagtagttttaagacatttctggtccattacaatangttcattcattatgcatcagctactgtgaggctat

SEQ ID NO: 41207 - DNA, 71 bp, chicken (Gallus Gallus)
  misc_feature (36): n=a or g
ctggtcctgccctgctgtatgaccgagccttcatcngcttccagtacagtctctttcctgagctcaaagca

SEQ ID NO: 41208 - DNA, 71 bp, chicken (Gallus Gallus)
  misc_feature (36): n=a or g
tctccattaattttcaaggcaactgaaaagaaagcngatgttgggaagtttgttgaacttcccggtgcaga

SEQ ID NO: 41209 - DNA, 71 bp, chicken (Gallus Gallus)
  misc_feature (36): n=c or t
tcctctttcagatttatagtttagggttcaacatcnctagtattagagctagagatacggttatttttaat

SEQ ID NO: 41210 - DNA, 71 bp, chicken (Gallus Gallus)
  misc_feature (36): n=c or t
tatctttaggctttctatgttaattgctagtattgntcttaagagcaaatcactggtttgtaaatttagat

SEQ ID NO: 41211 - DNA, 71 bp, chicken (Gallus Gallus)
  misc_feature (36): n=a or c
ccattgcattacataatgggaagtgctttggtttanacacagattattactgcactttgtaatcatcccat

SEQ ID NO: 41212 - DNA, 71 bp, chicken (Gallus Gallus)
  misc_feature (36): n=a or c
ataaaattagtgtatcactcagcatataagaagacnaagtgctttgctgtagtccagaaatacagaaacta

SEQ ID NO: 41213 - DNA, 71 bp, chicken (Gallus Gallus)
  misc_feature (36): n=a or g
atgttaaagtatatttagaaattctgttgacttcantcaccattgatctttgttactgaaattgggccctt

SEQ ID NO: 41214 - DNA, 71 bp, chicken (Gallus Gallus)
  misc_feature (36): n=a or g
aatccaagaagaaaaagcatctggtaaatcccagtngtcagtatcattagtatcataaggaaacatgtatt

SEQ ID NO: 41215 - DNA, 71 bp, chicken (Gallus Gallus)
  misc_feature (36): n=c or t
gagtgatgaaatccatagttttaattctaaatttanaatgaacacctgctgtgacatatggcaagcactgt

SEQ ID NO: 41216 - DNA, 71 bp, chicken (Gallus Gallus)
  misc_feature (36): n=c or t
aacgctgcctcacctgatggcttcacacaagtaccnttcagtagcatcttaaattagtactgattctttgc

SEQ ID NO: 41217 - DNA, 71 bp, chicken (Gallus Gallus)
  misc_feature (36): n=a or g
cccttctggagctatggtgaacccagcaatgctaanagaaaattcaggctgtgttttctcttactttaggt

SEQ ID NO: 41218 - DNA, 71 bp, chicken (Gallus Gallus)
  misc_feature (36): n=c or t
gaaggtctacacttctgcatatcttaccatccttcnacaccgagtgtcagtgattttcctaggtttcgcat

SEQ ID NO: 41219 - DNA, 71 bp, chicken (Gallus Gallus)
  misc_feature (36): n=c or t
tatacctgctttacacaattttaactgaaatctcangaagtctcatctccagtacccgtatagtggtggag

SEQ ID NO: 41220 - DNA, 71 bp, chicken (Gallus Gallus)
  misc_feature (36): n=a or g
acagaaacaatggattaatatatctctgtcaatgcntatctcgtggaaaggtttatttcacttctgagggt

SEQ ID NO: 41221 - DNA, 71 bp, chicken (Gallus Gallus)
  misc_feature (36): n=c or t
gcagcaggagatgagaattgtgcttctgctaaacantggttctgaacatcactgtttagggatatatatgt

SEQ ID NO: 41222 - DNA, 71 bp, chicken (Gallus Gallus)
  misc_feature (36): n=c or t
gggtctatcttcacttttctctacgtaactactttngatgtgatgctaactgcagatattggaaagaaatg

SEQ ID NO: 41223 - DNA, 71 bp, chicken (Gallus Gallus)
  misc_feature (36): n=a or g
gtttgttttcttctgaagtctcttcttaacccccantaatgtcagtctcctttttgcagtgctctgagctg

SEQ ID NO: 41224 - DNA, 71 bp, chicken (Gallus Gallus)
  misc_feature (36): n=a or g
ttatcatctgcacattacaggaaaattctatgtgcnctgtcatgaattcttatgattactcttaatttaag

SEQ ID NO: 41225 - DNA, 71 bp, chicken (Gallus Gallus)
  misc_feature (36): n=a or g
ttttaattgtagcagtttgatgcactctggacgctntggagagcatcgatgttttgattactaaatagaac

SEQ ID NO: 41226 - DNA, 71 bp, chicken (Gallus Gallus)
  misc_feature (36): n=a or g
aacctcaggctactctgcagcctataatactgaggncattggctacattaagattctttcacaaagtgcct

SEQ ID NO: 41227 - DNA, 71 bp, chicken (Gallus Gallus)
  misc_feature (36): n=a or c
tgttgcctttaagttcagagaagctatttccagttnagtatcccttgtatcctggcaacctgcacagtcct

SEQ ID NO: 41228 - DNA, 71 bp, chicken (Gallus Gallus)
  misc_feature (36): n=g or t
tttaactgtactacaaaatgaccatgctttggggcntatggaaagtatgttgcatgaagaaatacacctaa

SEQ ID NO: 41229 - DNA, 71 bp, chicken (Gallus Gallus)
  misc_feature (36): n=a or g
ttgcatgttccatagggcagctaaggtgagagatgngggagagcgattctaaagcatttgtgcaccttttg

SEQ ID NO: 41230 - DNA, 71 bp, chicken (Gallus Gallus)
  misc_feature (36): n=a or g
ccaaagccttcacaccagggcaggactcatgcacancaaaaagccttgcactctcccaaccaaggactgct

SEQ ID NO: 41231 - DNA, 71 bp, chicken (Gallus Gallus)
  misc_feature (36): n=c or t
tgctgttcagaattcttcaaaggaactctgtgtacnggcgtgcggtcccaaaataaggcactgaaaatctc

SEQ ID NO: 41232 - DNA, 71 bp, chicken (Gallus Gallus)
  misc_feature (36): n=c or t
gtgagatgctagaagataaaggatctcaccttgatnttggagagaacagccatgcacttctatattacact

SEQ ID NO: 41233 - DNA, 71 bp, chicken (Gallus Gallus)
  misc_feature (36): n=a or g
ctacatgcaacctaactagcagtgtcagtgttttcngaaatcagaaatgtagcacagctatgcaagtgaca

SEQ ID NO: 41234 - DNA, 71 bp, chicken (Gallus Gallus)
  misc_feature (36): n=c or t
tacttacttgctttttcatcaacagccgagcctatnattcacttcctaccttaggggatccgttttatgtc

SEQ ID NO: 41235 - DNA, 71 bp, chicken (Gallus Gallus)
  misc_feature (36): n=a or g
acattttctttatgcaacttccatcatttgtgcaancactttcatgcatatttcttgtatgcagcaaatgg

SEQ ID NO: 41236 - DNA, 71 bp, chicken (Gallus Gallus)
  misc_feature (36): n=c or t
atagcattttgagggctcttattatggttttaaaantgatattcagatttcaacttccctttttgctacaa

SEQ ID NO: 41237 - DNA, 71 bp, chicken (Gallus Gallus)
  misc_feature (36): n=a or g
ggatttgcctttactgaagggctttagtcttaatangctgaaggagaaggagccttttatgtcaaataata

SEQ ID NO: 41238 - DNA, 71 bp, chicken (Gallus Gallus)
  misc_feature (36): n=c or t
gctgctcttagcactctgtgatctgtatgtttcacntgttgcgtcaggaaaaagccgctatctagttactt

SEQ ID NO: 41239 - DNA, 71 bp, chicken (Gallus Gallus)
  misc_feature (36): n=a or g
catttctccccttttacagctctgtaatattgaccnttgtcagggatggcatcaaactagaatagacaaat

SEQ ID NO: 41240 - DNA, 71 bp, chicken (Gallus Gallus)
  misc_feature (36): n=c or t
ccgttccagcaaccgcctcctacaggagaagttctnaattcctctgctatcagtctctcatggaattcccc

SEQ ID NO: 41241 - DNA, 71 bp, chicken (Gallus Gallus)
  misc_feature (36): n=g or t
aatctgaatcctgaactaagtttttctccttccttnttttcccctgaaactaaacacaggttagcacatat

SEQ ID NO: 41242 - DNA, 71 bp, chicken (Gallus Gallus)
  misc_feature (36): n=c or t
tctgtcctcttcagactttttgtccctttgatcttngttcagctgttataactagagatagttagggagac

SEQ ID NO: 41243 - DNA, 71 bp, chicken (Gallus Gallus)
  misc_feature (36): n=g or t
atcttttgaactgcctaatggccacatcatccatanttgctgtctgtcagtattctaaaattgagtaggag

SEQ ID NO: 41244 - DNA, 71 bp, chicken (Gallus Gallus)
  misc_feature (36): n=a or g
cctcttctacgggttacaacttgaatgagttaccanaatagctgttgatgcttggtctttttgtgttgtgg

SEQ ID NO: 41245 - DNA, 71 bp, chicken (Gallus Gallus)
  misc_feature (36): n=g or t
gtttctagttggttatctgttgttctgcttcagtgntacagactttgttccataatttccatagtcattgg

SEQ ID NO: 41246 - DNA, 71 bp, chicken (Gallus Gallus)
  misc_feature (36): n=c or t
gtggtaatgttcactaatccggtatttgtagtctantcactttaaactagtgaaaatgtgaatgttctatt

SEQ ID NO: 41247 - DNA, 71 bp, chicken (Gallus Gallus)
  misc_feature (36): n=c or t
aaatctttatttcattgactagattgtgaccatcgntcttttttggatgttttagaactggttgtctgcca

SEQ ID NO: 41248 - DNA, 71 bp, chicken (Gallus Gallus)
  misc_feature (36): n=g or t
gagaaaagcattttaccccagcatgccaggattcangcaaagagattcttaactttttcctcacatagtct

SEQ ID NO: 41249 - DNA, 71 bp, chicken (Gallus Gallus)
  misc_feature (36): n=c or t
ttattccttacaactcactcttttaataaatcctgncaaatgccagtttgtcacataccattaaactttct

SEQ ID NO: 41250 - DNA, 71 bp, chicken (Gallus Gallus)
  misc_feature (36): n=a or g
tgtgtagaacaaatatattggggaatgacctatttntggaagtagtaaagaagaattaaggctttctataa

SEQ ID NO: 41251 - DNA, 71 bp, chicken (Gallus Gallus)
  misc_feature (36): n=g or t
ttgcacaagaggtttcattcagagtggttgaaggangcagtataaaggttcttggtccttgcaaagctgga

SEQ ID NO: 41252 - DNA, 71 bp, chicken (Gallus Gallus)
  misc_feature (36): n=c or t
aaataaacacataacaataaggaacatagaatccanatatcttgaacaaaagtaataaacagaccaaatca

SEQ ID NO: 41253 - DNA, 71 bp, chicken (Gallus Gallus)
  misc_feature (36): n=a or c
atacattttgagtattgtttcattttagagaactangaatattcatcataaatccttgtacatgcaagtgg

SEQ ID NO: 41254 - DNA, 71 bp, chicken (Gallus Gallus)
  misc_feature (36): n=a or g
ttgcacatgttgtttgcattagattaagctgttttncttgatgataggaatatgacattagggaatgataa

SEQ ID NO: 41255 - DNA, 71 bp, chicken (Gallus Gallus)
  misc_feature (36): n=a or g
gtaaatgtaacccacactttatgcaagaagatgagncacccaaatcattagttggcaagtcctgcaattct

SEQ ID NO: 41256 - DNA, 71 bp, chicken (Gallus Gallus)
  misc_feature (36): n=c or t
tctcctacagccgttttctccacggggattagtttnggtttattttttctcagtgctgggtttccaacagg

SEQ ID NO: 41257 - DNA, 71 bp, chicken (Gallus Gallus)
  misc_feature (36): n=c or t
cttcagttcttgcttccatacattgtttttcctccntatgctttctggacatttcagaaattatttcttct

SEQ ID NO: 41258 - DNA, 71 bp, chicken (Gallus Gallus)
  misc_feature (36): n=c or t
gctggctcacgctgactattccagaaacactgttangtgctgaagttcctcggagctggggaaatctgcct

SEQ ID NO: 41259 - DNA, 71 bp, chicken (Gallus Gallus)
  misc_feature (36): n=a or g
cgctcattaactctttccttacagtgcctccatccnaagtgtacaaataaacgcatttctattttgttctg

SEQ ID NO: 41260 - DNA, 71 bp, chicken (Gallus Gallus)
  misc_feature (36): n=a or g
cctgacaaaaagacaagtgtagctctggtcttaggngtatggctaagtccaagtatagaatgactccattg

SEQ ID NO: 41261 - DNA, 71 bp, chicken (Gallus Gallus)
  misc_feature (36): n=g or t
ctggggaatgatatgaatgatatggatatgaactgngtacataacgaaacactaaaatacatacacctata

SEQ ID NO: 41262 - DNA, 71 bp, chicken (Gallus Gallus)
  misc_feature (36): n=c or t
caccctttccttgcagtggtaaactaacttatctcnatgttactgttatgctacatctagctggattttta

SEQ ID NO: 41263 - DNA, 71 bp, chicken (Gallus Gallus)
  misc_feature (36): n=a or c
ttcagctgttaagatttgaaagacatttgctaagantatttctggccttttgagcagaattttccagcctt

SEQ ID NO: 41264 - DNA, 71 bp, chicken (Gallus Gallus)
  misc_feature (36): n=c or t
cagtctggcacatttagcctatgctcctcagattantttctaggagaaagctcagagtggataagccctgc

SEQ ID NO: 41265 - DNA, 71 bp, chicken (Gallus Gallus)
  misc_feature (36): n=a or g
cctttatcactaacaggtatgaatctcttactgggngctaatctagtaaccccacagctcatctgagaaga

SEQ ID NO: 41266 - DNA, 71 bp, chicken (Gallus Gallus)
  misc_feature (36): n=c or t
ttccacaaaatggtttcaattttaagcctttaggangaaatctttttgtgttttgataaaccgtggtatgc

SEQ ID NO: 41267 - DNA, 71 bp, chicken (Gallus Gallus)
  misc_feature (36): n=g or t
ttgaacacaaaccagggacagtgacgtgtaactatnttgcgtcatttctataacaatcaaagagatggaat

SEQ ID NO: 41268 - DNA, 71 bp, chicken (Gallus Gallus)
  misc_feature (36): n=a or g
tcacccgtgcatttatgactatgttctctatgtcangactaatacaaaagttatgcacatcaagaaagctg

SEQ ID NO: 41269 - DNA, 71 bp, chicken (Gallus Gallus)
  misc_feature (36): n=a or g
aagctgctccttcagttacacctcagctgcttttantcagcaaagctccaaatcgctgtatctcagagcat

SEQ ID NO: 41270 - DNA, 71 bp, chicken (Gallus Gallus)
  misc_feature (36): n=a or g
aactgcagattaggaacaagaaaatactaaccttcnaataataggagttaaatacctgtttcagcagtgct

SEQ ID NO: 41271 - DNA, 71 bp, chicken (Gallus Gallus)
  misc_feature (36): n=c or t
ttggaacagttagagcagagatgggactgagataanatatatggatagaagtccactcagagtatatgaat

SEQ ID NO: 41272 - DNA, 71 bp, chicken (Gallus Gallus)
  misc_feature (36): n=c or t
gtcaaattccaggcattagagaacttaacaaggagngcttgttgaacacacaagtggaatcatttttaggg

SEQ ID NO: 41273 - DNA, 71 bp, chicken (Gallus Gallus)
  misc_feature (36): n=c or t
cgcaataatatcagaagtctcgatcttttttcattnccccactgattctgatttatgatattattctcttc

SEQ ID NO: 41274 - DNA, 71 bp, chicken (Gallus Gallus)
  misc_feature (36): n=a or g
tagcctgtgaagccgggaaaatacacataaggtcanggaaacaaaagggactccccacttgttgattaatg

SEQ ID NO: 41275 - DNA, 71 bp, chicken (Gallus Gallus)
  misc_feature (36): n=g or t
gacacacaaggtggtaaaaactgcacatgaaggatncagacttttcccagtaaaatatcaattttcagagt

SEQ ID NO: 41276 - DNA, 71 bp, chicken (Gallus Gallus)
  misc_feature (36): n=c or t
agaatttacagcagctcctgtttgcaagtccttcantctttatagcatgagaatcaagtatcaggtacaga

SEQ ID NO: 41277 - DNA, 71 bp, chicken (Gallus Gallus)
  misc_feature (36): n=c or t
gcatggaaaaaatcaccatgagcttccataagatangatgggcagacaatggtttgttgtagctgtgggat

SEQ ID NO: 41278 - DNA, 71 bp, chicken (Gallus Gallus)
  misc_feature (36): n=a or g
ctcgcccctgcagtccctttacccaactaccaaaancatttgtggcaatcctctctctcctcttccatctc

SEQ ID NO: 41279 - DNA, 71 bp, chicken (Gallus Gallus)
  misc_feature (36): n=g or t
cagcaatacctaaggagtaacttagaaaaaaacttntcagaccagcactgtggttttgcgtcattctcaac

SEQ ID NO: 41280 - DNA, 71 bp, chicken (Gallus Gallus)
  misc_feature (36): n=c or t
atgctctctagccaatacagcataagaaatccctcnttgcactgaattaaacattcatagaacaagaagtt

SEQ ID NO: 41281 - DNA, 71 bp, chicken (Gallus Gallus)
  misc_feature (36): n=a or g
ccccttccttgctattgaagtctttttacagaaaangtactctggagaccaggggttctattgaatagttt

SEQ ID NO: 41282 - DNA, 71 bp, chicken (Gallus Gallus)
  misc_feature (36): n=a or g
ttattttcgaaaggcatcttctatactatcttcaantttcagctccattattaaaacataacagcaacaga

SEQ ID NO: 41283 - DNA, 71 bp, chicken (Gallus Gallus)
  misc_feature (36): n=a or g
catcaaaataaagaaaagaaccacatgctatggggncattccctctgctccaaaacataactgcagctgat

SEQ ID NO: 41284 - DNA, 71 bp, chicken (Gallus Gallus)
  misc_feature (36): n=a or g
ccagatagctaatggtattaagacacttaagagatngagactgcaccgtaatgggattttttcagaaatcc

SEQ ID NO: 41285 - DNA, 71 bp, chicken (Gallus Gallus)
  misc_feature (36): n=c or t
ctgacataactgcatgatggatgtgcaaacttcagnccatttcccaataaaacctcatttggtgcctggaa

SEQ ID NO: 41286 - DNA, 71 bp, chicken (Gallus Gallus)
  misc_feature (36): n=c or t
tggctgactgtgcgtgagcatgtgttttgtgtggangcctcatccccgattctgaacaccctcataaaaga

SEQ ID NO: 41287 - DNA, 71 bp, chicken (Gallus Gallus)
  misc_feature (36): n=c or t
gctgagtagaagtgtaatggagaaggttgaacatantggagatgaacagcattcactctggaaaaattcac

SEQ ID NO: 41288 - DNA, 71 bp, chicken (Gallus Gallus)
  misc_feature (36): n=a or g
attttgagaggtatagtctctgcacccaatcattcnagatacttaagtgcttcatctgtggagatgatgaa

SEQ ID NO: 41289 - DNA, 71 bp, chicken (Gallus Gallus)
  misc_feature (36): n=c or t
tgtttgtatttgacataattagtgctcttttggtgnaagctgcttagagaactgaccattcacccctcagt

SEQ ID NO: 41290 - DNA, 71 bp, chicken (Gallus Gallus)
  misc_feature (36): n=a or g
agcagcaccaaattcaggagtttgtgacttctgtgntaagttcttgcctccaagcaagtgtaagcagaact

SEQ ID NO: 41291 - DNA, 71 bp, chicken (Gallus Gallus)
  misc_feature (36): n=g or t
agaacaagaccctcttgaactggtttcttttaaganccagaccgtataaaccactgtgctctgcaggatcc

SEQ ID NO: 41292 - DNA, 71 bp, chicken (Gallus Gallus)
  misc_feature (36): n=c or t
taccaattccttcattttaattaccctagaagcatntcgtacttcagctaataaataaagcattcaagttg

SEQ ID NO: 41293 - DNA, 71 bp, chicken (Gallus Gallus)
  misc_feature (36): n=c or t
ttgctatgataaccttatgtattttaattattatanttggaaatgatccattcctatctccaaatatgtgt

SEQ ID NO: 41294 - DNA, 71 bp, chicken (Gallus Gallus)
  misc_feature (36): n=a or g
gggagagataattgttgtatggtaatcactctccanggcaaatctttgtcttatgtttaagcaggtacacc

SEQ ID NO: 41295 - DNA, 71 bp, chicken (Gallus Gallus)
  misc_feature (36): n=c or t
tctagttgcttgccagatgagcaaggaagttctggnttgatttcagttttgcctgttttggtcataggccc

SEQ ID NO: 41296 - DNA, 71 bp, chicken (Gallus Gallus)
  misc_feature (36): n=c or t
atctccagaggtgtggacgcatctctaaccaggcangtgttcttgttccactcttgaatagttatgtttct

SEQ ID NO: 41297 - DNA, 71 bp, chicken (Gallus Gallus)
  misc_feature (36): n=a or g
gacgtagaatttttctcatgaagtcagaagcagctntgggattttgatagaaaattagaaactggaggtaa

SEQ ID NO: 41298 - DNA, 71 bp, chicken (Gallus Gallus)
  misc_feature (36): n=a or g
atacttgatagatgcaggtgatagtgttgctgtacntgtcttcttgtgcttaattaagttaaatgcaaatg

SEQ ID NO: 41299 - DNA, 71 bp, chicken (Gallus Gallus)
  misc_feature (36): n=a or g
gacaagggcaggactggaacatgctgtcccataagnggaaaatggcagaagactgaacagtttcatgggat

SEQ ID NO: 41300 - DNA, 71 bp, chicken (Gallus Gallus)
  misc_feature (36): n=a or g
gctctcttctcctgaggttgaagtgaaatccccacnatagcctcaggggttagtcctgcacaggcatcttt

SEQ ID NO: 41301 - DNA, 71 bp, chicken (Gallus Gallus)
  misc_feature (36): n=a or g
aaaatgaatttcaataatgatgaaggcaaaatgatntatttaggaacgtacaacaatatatgtggtggaag

SEQ ID NO: 41302 - DNA, 71 bp, chicken (Gallus Gallus)
  misc_feature (36): n=c or t
ggcagcctgttccaatggatttaatggtatactttnggtcatttttcactatttttggttgtacttattac

SEQ ID NO: 41303 - DNA, 71 bp, chicken (Gallus Gallus)
  misc_feature (36): n=c or t
cactgctgtttgtccttaccactgctggtcctatangaaatacacagaaagtaattcagcaaagttagcaa

SEQ ID NO: 41304 - DNA, 71 bp, chicken (Gallus Gallus)
  misc_feature (36): n=a or g
aagaatacagggatatatcatatatacatgtaaccnagctgacctgtattattttgaaaaagatgatcaat

SEQ ID NO: 41305 - DNA, 71 bp, chicken (Gallus Gallus)
  misc_feature (36): n=a or g
agatagaggtagggggaatgctgttttaacaggtanttatggtagagatagcatacatcccttataaaact

SEQ ID NO: 41306 - DNA, 71 bp, chicken (Gallus Gallus)
  misc_feature (36): n=a or g
atctctttgggttatagtatataatgctttcaagantaacaattcctcttctctggtttgaggcatctata

SEQ ID NO: 41307 - DNA, 71 bp, chicken (Gallus Gallus)
  misc_feature (36): n=c or t
ggtatcctatcagtgaacaaagctgcaggacctatntgtcaagtgcttgagatagggaacagaaagcatgt

SEQ ID NO: 41308 - DNA, 71 bp, chicken (Gallus Gallus)
  misc_feature (36): n=a or c
taatagcactttgctacagtgtcagatagctgttcnaagtaccttagttccatctttgtttttattcagta

SEQ ID NO: 41309 - DNA, 71 bp, chicken (Gallus Gallus)
  misc_feature (36): n=a or g
gttttcagtgaagtgaaccgggatctctcatcagcntggatgggactgcatcggttcatggtggcattttc

SEQ ID NO: 41310 - DNA, 71 bp, chicken (Gallus Gallus)
  misc_feature (36): n=c or t
gagcttgggtttcagtaagtaaagaaaataacctcnaaattctaatacaacctcagaatttctgcaaatga

SEQ ID NO: 41311 - DNA, 71 bp, chicken (Gallus Gallus)
  misc_feature (36): n=a or c
atgatacaagtattttgtcagtcaagatatttcacntggtgttttatgaagagtgtggagtatcttctgtt

SEQ ID NO: 41312 - DNA, 71 bp, chicken (Gallus Gallus)
  misc_feature (36): n=c or t
attgagtcgcttaatagtctttgtaacaaatagctnacagctgaggtacaacagggctcttgaatcactta

SEQ ID NO: 41313 - DNA, 71 bp, chicken (Gallus Gallus)
  misc_feature (36): n=a or g
gctccactgccttctcatctgtattgggcagtagcnggggcagcttctgtcaaataacaccttcatttatg

SEQ ID NO: 41314 - DNA, 71 bp, chicken (Gallus Gallus)
  misc_feature (36): n=g or t
aacagacacgtcccaagggcagagctggcaacgatnctgcctggcacaagcctgagctgcgtactgagtgt

SEQ ID NO: 41315 - DNA, 71 bp, chicken (Gallus Gallus)
  misc_feature (36): n=c or t
ctctagacagcaagagcctaattaacagtaacttgngtgcttgctttctcataaataaaccctcatgaaac

SEQ ID NO: 41316 - DNA, 71 bp, chicken (Gallus Gallus)
  misc_feature (36): n=g or t
ctttattggaagaaatattcctgaggaatttcactnctctaaaattcaccattatttcactacagaatgaa

SEQ ID NO: 41317 - DNA, 71 bp, chicken (Gallus Gallus)
  misc_feature (36): n=c or t
cttgttttatttctgggaatactggtgctcaaaatnccagttcctctgtaaatttctaagcattcaggggt

SEQ ID NO: 41318 - DNA, 71 bp, chicken (Gallus Gallus)
  misc_feature (36): n=c or t
tttgaatttagtggaattgctcctccagtgcccagngttatgatttaccctttggcagagtggggaggaga

SEQ ID NO: 41319 - DNA, 71 bp, chicken (Gallus Gallus)
  misc_feature (36): n=a or c
cactgattggcatgatagaaggtcttctgttacccntaaactacaattaagtgtgatgaggccaaaccaca

SEQ ID NO: 41320 - DNA, 71 bp, chicken (Gallus Gallus)
  misc_feature (36): n=c or t
ggctactatgaaacctgcacaattatcctgcataangaataacacatactgaagaaatgctgaaataattt

SEQ ID NO: 41321 - DNA, 71 bp, chicken (Gallus Gallus)
  misc_feature (36): n=c or t
ggatgaagtcaacctgccttgcaactgacaagctgnaatattaaagcctgctttagacaagatagcttttt

SEQ ID NO: 41322 - DNA, 71 bp, chicken (Gallus Gallus)
  misc_feature (36): n=a or g
cagccttgcagtggattcagaactccaaaacaaatnaacaaaaatttgactaccattgtgttaaatgtagt

SEQ ID NO: 41323 - DNA, 71 bp, chicken (Gallus Gallus)
  misc_feature (36): n=c or t
taaaagaaacatagaaggacacattataaaaacagncatgtataagtgtagcttgcaaaagtttttatatt

SEQ ID NO: 41324 - DNA, 71 bp, chicken (Gallus Gallus)
  misc_feature (36): n=a or g
aaaaatttaaggtgttaacattaaggagatgataantcactaatattattcttgagctaggaaggtagttc

SEQ ID NO: 41325 - DNA, 71 bp, chicken (Gallus Gallus)
  misc_feature (36): n=a or g
aatgtaaactggtatgatcacatagcaacaatgaanaagtgcttacagacttttaaaagctgcaaaaagct

SEQ ID NO: 41326 - DNA, 71 bp, chicken (Gallus Gallus)
  misc_feature (36): n=a or g
gctgtacaagccatctgttccccgtcttttccagtnaggaccaaagcagaagaggcaccagatgccagtat

SEQ ID NO: 41327 - DNA, 71 bp, chicken (Gallus Gallus)
  misc_feature (36): n=c or t
tcagagccccgagtctcgccagccccgatggctccnggacattaaggaagaacctgttagattagccctca

SEQ ID NO: 41328 - DNA, 71 bp, chicken (Gallus Gallus)
  misc_feature (36): n=a or g
ccaaaaatcactgcatgttaagatatgaagcccccnctattatttgaagacatgaaacacacgtacagcac

SEQ ID NO: 41329 - DNA, 71 bp, chicken (Gallus Gallus)
  misc_feature (36): n=g or t
ctgtgtttccgtccccagcgcaggattttcttccangtatagtagtattccacgcactgtgcaactgtctt

SEQ ID NO: 41330 - DNA, 71 bp, chicken (Gallus Gallus)
  misc_feature (36): n=a or g
tgcagatactcagcatcagtaagatacgtctgacantagagtagaactacaacatttaaggagagccatgc

SEQ ID NO: 41331 - DNA, 71 bp, chicken (Gallus Gallus)
  misc_feature (36): n=a or g
tgctccctaccaacagttgttttggtgtaattaccngttgtctcgtggctaaatgtttgaacctgagtgtt

SEQ ID NO: 41332 - DNA, 71 bp, chicken (Gallus Gallus)
  misc_feature (36): n=a or c
gcatgtgtatgtttatatgcatattcacataaactntgttgtttttgaataattatagatgacaacatcag

SEQ ID NO: 41333 - DNA, 71 bp, chicken (Gallus Gallus)
  misc_feature (36): n=c or t
agatacagcgatactggagggtcacaaatacagttngtgttgacttggagcagttctcttactaaggagag

SEQ ID NO: 41334 - DNA, 71 bp, chicken (Gallus Gallus)
  misc_feature (36): n=a or g
agcccttagattctttcacatgaatctgctgcttcntgatcttttttatcttcttttggggtaataatgta

SEQ ID NO: 41335 - DNA, 71 bp, chicken (Gallus Gallus)
  misc_feature (36): n=c or t
tgactcagattttgtgatgaacatggttgattgttngaaatgtctttgtgcagtgacagtaaatctgatca

SEQ ID NO: 41336 - DNA, 71 bp, chicken (Gallus Gallus)
  misc_feature (36): n=c or t
tcttacagtgaagattcatagctgactctgggaacntgtgaatgtgatggatatttcatgccatcactgat

SEQ ID NO: 41337 - DNA, 71 bp, chicken (Gallus Gallus)
  misc_feature (36): n=a or g
catgcaaaatgtgcgtttttagaagaccgagaagangtaatgaaaatattgttgctccagtttggtcctaa

SEQ ID NO: 41338 - DNA, 71 bp, chicken (Gallus Gallus)
  misc_feature (36): n=a or g
cttcagtttagttatcctgtaggcctaaagaggtantgaaaatgtaagtagatgtgtttctgtgaacacac

SEQ ID NO: 41339 - DNA, 71 bp, chicken (Gallus Gallus)
  misc_feature (36): n=c or t
tgagagaaggcaaactatgaaaaggtaggcagaagnctactaaagcaagcagttgagcatgtttcagtctg

SEQ ID NO: 41340 - DNA, 71 bp, chicken (Gallus Gallus)
  misc_feature (36): n=a or g
atctttcagctgttttctcttggtcttttgcttagngattgcgcagagcctgaaacgtttcaaaatgaagt

SEQ ID NO: 41341 - DNA, 71 bp, chicken (Gallus Gallus)
  misc_feature (36): n=c or t
tattaatgagcaattatatcttgagtttaaatggantgattattctttttttgagagaacaccactgcaca

SEQ ID NO: 41342 - DNA, 71 bp, chicken (Gallus Gallus)
  misc_feature (36): n=a or g
attaaacagtgttggtctgcgtcctgatctatggancacctcattattaatctctttccctaccagaattg

SEQ ID NO: 41343 - DNA, 71 bp, chicken (Gallus Gallus)
  misc_feature (36): n=g or t
tgtttacagagccgtgttggttttgctggcagcgcnctgtagcgaggccgcagcccctctcgccgtgccgc

SEQ ID NO: 41344 - DNA, 71 bp, chicken (Gallus Gallus)
  misc_feature (36): n=a or c
acgcctctgtggtgttttcttccccaaaggatatantatgggtgcaacccaagctttattgtgcttaatct

SEQ ID NO: 41345 - DNA, 71 bp, chicken (Gallus Gallus)
  misc_feature (36): n=c or t
tgtgttcatatattcatgggaattagagaggagaangtgacatctcatcctgcagactctcaaactcattg

SEQ ID NO: 41346 - DNA, 71 bp, chicken (Gallus Gallus)
  misc_feature (36): n=c or t
ttcagtatgataagctaagttactccttagaaatgngcagaaaattaaaacaaaataaaatctacacatga

SEQ ID NO: 41347 - DNA, 71 bp, chicken (Gallus Gallus)
  misc_feature (36): n=c or t
ataccatcatatcagtaaaggactgttttcttggtntccttgtgtccaagagaagttaagagaggaaggac

SEQ ID NO: 41348 - DNA, 71 bp, chicken (Gallus Gallus)
  misc_feature (36): n=c or t
aataggttaccactgctagtattaaagcttcacagncatcttttaaacacaccatcttctgcttggttttt

SEQ ID NO: 41349 - DNA, 71 bp, chicken (Gallus Gallus)
  misc_feature (36): n=g or t
tactgcagactttaggaggttgaccactgtgaatcnactaccacgcaacttatttcacatgtgcttatctt

SEQ ID NO: 41350 - DNA, 71 bp, chicken (Gallus Gallus)
  misc_feature (36): n=c or t
aggattaataactttttctcaattcaactaagtgtnctatactgaaatctgaagttaaattctaaacttca

SEQ ID NO: 41351 - DNA, 71 bp, chicken (Gallus Gallus)
  misc_feature (36): n=a or c
ctccctacagagctgcctgacaataagaacttccancagtgaaaatgcagagtaaattctcctgagaacgc

SEQ ID NO: 41352 - DNA, 71 bp, chicken (Gallus Gallus)
  misc_feature (36): n=a or g
cattcccatggtcttttggatctggtgctgggctgnattctagctgtcttcaagcaaattcttcagatttg

SEQ ID NO: 41353 - DNA, 71 bp, chicken (Gallus Gallus)
  misc_feature (36): n=a or g
ttttgtaacacatggtgtgtatgatgacagtgcagntctgtgctcttgctgctgttgactgtttctagtag

SEQ ID NO: 41354 - DNA, 71 bp, chicken (Gallus Gallus)
  misc_feature (36): n=a or g
gatactgtgatgaatgaacttcaattttacaccagncatcactttttttaattatcaaaacgtcacctgca

SEQ ID NO: 41355 - DNA, 71 bp, chicken (Gallus Gallus)
  misc_feature (36): n=c or t
ccttctcattcactacaagttacagtgagcatctgngaagcagtttgcatgcctaatggacttagacatga

SEQ ID NO: 41356 - DNA, 71 bp, chicken (Gallus Gallus)
  misc_feature (36): n=a or g
ctgagaatgaaacgcccaaatacatttgcatgaagnttaccaaactttactctgcctaagaagtggtacat

SEQ ID NO: 41357 - DNA, 71 bp, chicken (Gallus Gallus)
  misc_feature (36): n=a or g
tgggcatctgatgcagctgaataaccatgcagcaanaacagacattcaggtggttactcttaacatacatg

SEQ ID NO: 41358 - DNA, 71 bp, chicken (Gallus Gallus)
  misc_feature (36): n=a or g
atgtcctgtataaccaacgggagtacaggaagcagnaaaacaagccacatttcctctgtatctgttgccag

SEQ ID NO: 41359 - DNA, 71 bp, chicken (Gallus Gallus)
  misc_feature (36): n=c or t
tagtgtcagcaaaaaaacctaatgcttgagtaaaanattctacccagacacatttagtttctcctgcagta

SEQ ID NO: 41360 - DNA, 71 bp, chicken (Gallus Gallus)
  misc_feature (36): n=a or g
gtgctgccctgccagaattttgtataaacgtaaagntttaataacgtgcatttattacatatggaaatgtg

SEQ ID NO: 41361 - DNA, 71 bp, chicken (Gallus Gallus)
  misc_feature (36): n=a or g
atgggtaaattaaaatcatataagaatagaaatctnatatatgtggtagaaccagtaaagggttttaggtc

SEQ ID NO: 41362 - DNA, 71 bp, chicken (Gallus Gallus)
  misc_feature (36): n=a or g
ctcatctccatgaaggccctgggagagcaggagaancatttttaaaacttcctattttcctaaaattatct

SEQ ID NO: 41363 - DNA, 71 bp, chicken (Gallus Gallus)
  misc_feature (36): n=c or t
ggaaaacagcaaggctgagcagcaggagttttctanttgccttatggtttccatgtgccttgatgagtatg

SEQ ID NO: 41364 - DNA, 71 bp, chicken (Gallus Gallus)
  misc_feature (36): n=a or g
ttctctgctctggctccaacctgacagtcataagcnttctgtggtaacacacctgtgtcatgaatcagact

SEQ ID NO: 41365 - DNA, 71 bp, chicken (Gallus Gallus)
  misc_feature (36): n=a or g
ttgtgaaagcagttgtttgttccaggttagtgatgnagtattgtttcattctcccattttcagatgtgaaa

SEQ ID NO: 41366 - DNA, 71 bp, chicken (Gallus Gallus)
  misc_feature (36): n=a or g
ctaacaatttctgttatatcacaactttttacttcncaaatttactcacactcacactccttaattaaata

SEQ ID NO: 41367 - DNA, 71 bp, chicken (Gallus Gallus)
  misc_feature (36): n=a or g
cccctaacgatggatttgtacctacagaactaatgnttttccagcttaggtagcatgcagcatgtaatgtg

SEQ ID NO: 41368 - DNA, 71 bp, chicken (Gallus Gallus)
  misc_feature (36): n=c or t
ttaagcatctatcaaaaactaacttagctgtcttcncattttggtgtgccaagtggtggacttaaattttc

SEQ ID NO: 41369 - DNA, 71 bp, chicken (Gallus Gallus)
  misc_feature (36): n=c or t
tgattttatgtactgggtaatgtcatccatatatgnttctacctggaagcctgaaaattttgtaagcagct

SEQ ID NO: 41370 - DNA, 71 bp, chicken (Gallus Gallus)
  misc_feature (36): n=c or t
ttccttgaaaagtttcagttgtcataagatgaattnagggctatgtgagaggttgcatgctacgcttattg

SEQ ID NO: 41371 - DNA, 71 bp, chicken (Gallus Gallus)
  misc_feature (36): n=c or t
caacgtaaagtatttatcaaacttgttatttgccanattgattagtttttgattaagcaagcagagaatct

SEQ ID NO: 41372 - DNA, 71 bp, chicken (Gallus Gallus)
  misc_feature (36): n=a or g
tagttgttgggaaaggaccttttattactttgctgngctgcagataataaccaatgtgtgagttgtactct

SEQ ID NO: 41373 - DNA, 71 bp, chicken (Gallus Gallus)
  misc_feature (36): n=c or t
agtttcttgccaagttgcatttggtatgtatcacanttctcctgaagagaatagcaagatactatcccata

SEQ ID NO: 41374 - DNA, 71 bp, chicken (Gallus Gallus)
  misc_feature (36): n=a or c
ttttataacaacaaaaggcatgataggaacaaaaanacactgaactaacatttcaacattaactgcatcag

SEQ ID NO: 41375 - DNA, 71 bp, chicken (Gallus Gallus)
  misc_feature (36): n=a or c
ctttgaccagaaactgtacagattatcatcctctantatttggtgatgagaagtgcttgtgtatgtgttgt

SEQ ID NO: 41376 - DNA, 71 bp, chicken (Gallus Gallus)
  misc_feature (36): n=c or t
aaccacagttttttctgacaccaatctaacctgttnacagtttattgtctggggttccatctcagagttaa

SEQ ID NO: 41377 - DNA, 71 bp, chicken (Gallus Gallus)
  misc_feature (36): n=c or t
agtttctgtgcatgaagttgaattccagcatggacnacacttgtttattcctgaaattcgcatataaaacc

SEQ ID NO: 41378 - DNA, 71 bp, chicken (Gallus Gallus)
  misc_feature (36): n=a or g
acttcattctgaactacgacgtaccagctgaaatanggatataaaattatgtagataaaaatcacgtacaa

SEQ ID NO: 41379 - DNA, 71 bp, chicken (Gallus Gallus)
  misc_feature (36): n=a or c
tacctacactgcttggaaaaagactgcaggctccanccagagattaaatgggccataggatgacagagtgt

SEQ ID NO: 41380 - DNA, 71 bp, chicken (Gallus Gallus)
  misc_feature (36): n=g or t
aagtagtcctactccctgaatacaaacagctgaaantttctggataagccaagacaaactcttcaattttt

SEQ ID NO: 41381 - DNA, 71 bp, chicken (Gallus Gallus)
  misc_feature (36): n=a or g
gaaaactccatgggggatcatgtttcagcacacaantgtccttgtacagtatgcatttcctctttggttcg

SEQ ID NO: 41382 - DNA, 71 bp, chicken (Gallus Gallus)
  misc_feature (36): n=a or g
gcttctgaaaaaactctttgggcttaaccttgcatntatcactgttatcttacataatctgctggtaaagc

SEQ ID NO: 41383 - DNA, 71 bp, chicken (Gallus Gallus)
  misc_feature (36): n=c or t
ttgactacagcaatgaagttgttatgtatattagantgtgactttttgttgtaatcagaccacatcagcaa

SEQ ID NO: 41384 - DNA, 71 bp, chicken (Gallus Gallus)
  misc_feature (36): n=a or c
gattcgcgctgcagggaaggcaggctcacaaaaganggctcgcagggaaggtggcagttgggttgggtttc

SEQ ID NO: 41385 - DNA, 71 bp, chicken (Gallus Gallus)
  misc_feature (36): n=g or t
ctctgtctctttggagcatctgtccaattggctggntgtttcagctatgtggatattctgctgatagctat

SEQ ID NO: 41386 - DNA, 71 bp, chicken (Gallus Gallus)
  misc_feature (36): n=a or c
cacactcacatcccccgtgaattggagccagctgcnaagtttacaccaatgaaatataaagtcagggaaca

SEQ ID NO: 41387 - DNA, 71 bp, chicken (Gallus Gallus)
  misc_feature (36): n=a or c
tgtaacacagcctgactagaaagggacagagggacnatgtgcactgttctacacttggtttctatggagaa

SEQ ID NO: 41388 - DNA, 71 bp, chicken (Gallus Gallus)
  misc_feature (36): n=a or c
ctgctgttctggttttgagttcctgtgggcaaaaanagcagtgtcatggtgatgaaatttttaattaagag

SEQ ID NO: 41389 - DNA, 71 bp, chicken (Gallus Gallus)
  misc_feature (36): n=a or g
agaattcagagtttgtttcaacaactaagccctaancactggaaaaataggaccatgttcctttccattca

SEQ ID NO: 41390 - DNA, 71 bp, chicken (Gallus Gallus)
  misc_feature (36): n=g or t
cagcctgcagttacagcatgtgattgctggcctgtntttcactcagccttttgcttcatgatgggcgctgc

SEQ ID NO: 41391 - DNA, 71 bp, chicken (Gallus Gallus)
  misc_feature (36): n=g or t
gccttggccaacagacaggagattattaactcaagnatgagcaaaacaggtctgtttaactcccctttatg

SEQ ID NO: 41392 - DNA, 71 bp, chicken (Gallus Gallus)
  misc_feature (36): n=a or g
aagctaatatgttgctgaaaggaattctgtgtgganaaatgttcacacagagataacgttataatttctgt

SEQ ID NO: 41393 - DNA, 71 bp, chicken (Gallus Gallus)
  misc_feature (36): n=c or t
gcacagcggtttgttgtctgggggttgtttgctttnattataccaaaacagcttcccataccaaagacaga

SEQ ID NO: 41394 - DNA, 71 bp, chicken (Gallus Gallus)
  misc_feature (36): n=a or g
gaaaatactaaccatgctcatttgtagaataagacnttttgcaagctctaagtatctctacgtgattaata

SEQ ID NO: 41395 - DNA, 71 bp, chicken (Gallus Gallus)
  misc_feature (36): n=a or g
ttggcattagagcaagctctgtcacgcaaacgtganctcaagagatcaggctaaatactcccagtgggttt

SEQ ID NO: 41396 - DNA, 71 bp, chicken (Gallus Gallus)
  misc_feature (36): n=a or g
tgactatataatgaaaagtgtcaggtaacgctaacnacagaccatcagccttgcttataaaaatacacagc

SEQ ID NO: 41397 - DNA, 71 bp, chicken (Gallus Gallus)
  misc_feature (36): n=a or g
tcatgctgtgctggtctctgtctttacacatttctnctctggcttttcacttcctgttgtgtgcagccccc

SEQ ID NO: 41398 - DNA, 71 bp, chicken (Gallus Gallus)
  misc_feature (36): n=a or g
tatacaaagtacaagaacttcagagaagaatataantttaataaagaacctaaatcttcatcccaatggaa

SEQ ID NO: 41399 - DNA, 71 bp, chicken (Gallus Gallus)
  misc_feature (36): n=a or g
ggaatacagtctgttattaatttggtggcagtgtantcatccaaagggcaaggggagaagcatggagtttg

SEQ ID NO: 41400 - DNA, 71 bp, chicken (Gallus Gallus)
  misc_feature (36): n=c or t
agttgtaaaaatatgtttgcacatccattatatgantatacttctgtgttactgtatatgtatatccaaat

SEQ ID NO: 41401 - DNA, 71 bp, chicken (Gallus Gallus)
  misc_feature (36): n=a or c
actgaggatatccagctttggcaaggctaaaaatcncctgcatcaaaactctatccataaggtacccttca

SEQ ID NO: 41402 - DNA, 71 bp, chicken (Gallus Gallus)
  misc_feature (36): n=c or t
gtatttgagctcattcctgcctgagttaagttttgnagtgactgacttgtcctgcagcagtggggatgttg

SEQ ID NO: 41403 - DNA, 71 bp, chicken (Gallus Gallus)
  misc_feature (36): n=c or t
ttattttgcttttcagctccttttgttactttgggnttcgtagatgtacagaatacagcataactaactga

SEQ ID NO: 41404 - DNA, 71 bp, chicken (Gallus Gallus)
  misc_feature (36): n=a or g
ggttataacaattattaatagttttgcccatttatntaatttaagtgaagtatagctaatttatcagtaac

SEQ ID NO: 41405 - DNA, 71 bp, chicken (Gallus Gallus)
  misc_feature (36): n=c or t
tttcagtaatgtaaagtaaatgtgcttatattatgntatgggatgaatgagttccagggaagataagacac

SEQ ID NO: 41406 - DNA, 71 bp, chicken (Gallus Gallus)
  misc_feature (36): n=c or t
acagctctagaccaaactcatcctgaatcataccangagttgttatttctagagacacaatgtacttttga

SEQ ID NO: 41407 - DNA, 71 bp, chicken (Gallus Gallus)
  misc_feature (36): n=a or g
ataagattttgacacggtgcagagtgaacactggtngtctcttccactgacactggggatgacctgggggt

SEQ ID NO: 41408 - DNA, 71 bp, chicken (Gallus Gallus)
  misc_feature (36): n=a or g
tacggaccatctcctgttgagctgttaggacagacnatttggtcttcatgatgaggaaggaagagctgcct

SEQ ID NO: 41409 - DNA, 71 bp, chicken (Gallus Gallus)
  misc_feature (36): n=a or g
acctttaagaccagctcatgtttcactaaacagttncaagaaatgctaaactcgttagaaattgttctagc

SEQ ID NO: 41410 - DNA, 71 bp, chicken (Gallus Gallus)
  misc_feature (36): n=a or g
tatactgcagcagggtttagatattccaaagttacntgtcttatgttttctgaactccctctcatccccat

SEQ ID NO: 41411 - DNA, 71 bp, chicken (Gallus Gallus)
  misc_feature (36): n=c or t
aatgtaactaactggagagaaacctaatgagaatgnacaacacgtagtaccccctaactgtatgaaatttt

SEQ ID NO: 41412 - DNA, 71 bp, chicken (Gallus Gallus)
  misc_feature (36): n=c or t
gggctatttaatcagcacttgtcaagtcctgacctnctgtaacaggggcccagagtgctagtacaataaaa

SEQ ID NO: 41413 - DNA, 71 bp, chicken (Gallus Gallus)
  misc_feature (36): n=a or g
cctcttttggctttgctatgaatacatatacttgtnaagtcaattatgttttgtgttaaacatgcgaaata

SEQ ID NO: 41414 - DNA, 71 bp, chicken (Gallus Gallus)
  misc_feature (36): n=a or g
ttgaaggaaagcacctttacaatgctttactgtaantctatttccattgctcaaacaccacaccaagtaat

SEQ ID NO: 41415 - DNA, 71 bp, chicken (Gallus Gallus)
  misc_feature (36): n=g or t
agcaggatcctgcagatggaggagccagcctggctnctctgagaaacagcaaatggtgcaaatcctgggac

SEQ ID NO: 41416 - DNA, 71 bp, chicken (Gallus Gallus)
  misc_feature (36): n=a or g
aaaaaattaaatgtgttaagccatgacaatcctgcnataggaaccacgaagcaaaaagatgagaaaagaat

SEQ ID NO: 41417 - DNA, 71 bp, chicken (Gallus Gallus)
  misc_feature (36): n=a or c
tcgaggccaaacctaagggagcacaattcacccagncctgtccctcttggtgtgaggaatcaatcccgggg

SEQ ID NO: 41418 - DNA, 71 bp, chicken (Gallus Gallus)
  misc_feature (36): n=a or g
ataaagactatggccatctcacccagctctgtcaanacacctctttcctgtcttcaaactaggaatctatt

SEQ ID NO: 41419 - DNA, 71 bp, chicken (Gallus Gallus)
  misc_feature (36): n=a or g
aatccatccttaggctctttcaaagaaatcacacanatctgagtacctctgtctaaagcagaaagaagaga

SEQ ID NO: 41420 - DNA, 71 bp, chicken (Gallus Gallus)
  misc_feature (36): n=c or t
ggttgttgataccataggcttctcaagaaattctangctattactacctagagtactacattaaagggaaa

SEQ ID NO: 41421 - DNA, 71 bp, chicken (Gallus Gallus)
  misc_feature (36): n=c or t
gaggtaataagcgttaaaaaacattgctggaaagtntggcttttaagatgcagggagaggagcgttttccc

SEQ ID NO: 41422 - DNA, 71 bp, chicken (Gallus Gallus)
  misc_feature (36): n=a or g
aagttattacaccaccaaaatagaccagatgctgtntttgagagatattatagttatccaaaggattcctt

SEQ ID NO: 41423 - DNA, 71 bp, chicken (Gallus Gallus)
  misc_feature (36): n=a or g
agaaagcagagtctggacaaaggagctcccttctgntccttccttcccttaccctgatcattagcaacagg

SEQ ID NO: 41424 - DNA, 71 bp, chicken (Gallus Gallus)
  misc_feature (36): n=c or t
gagtgcctgtgctctgcattgtgtcatacatagagngcatttaatctctacttacatacagattgtgctga

SEQ ID NO: 41425 - DNA, 71 bp, chicken (Gallus Gallus)
  misc_feature (36): n=g or t
tatgaataagaagtgagatggcaaatctgaggtttnaaggtctgtggttaataaatctttatacttctgag

SEQ ID NO: 41426 - DNA, 71 bp, chicken (Gallus Gallus)
  misc_feature (36): n=c or t
aattaaaaaacaactcaaaccttaacctcgcaaaanttgtatttgtgtaaatggtctttatggagaggatt

SEQ ID NO: 41427 - DNA, 71 bp, chicken (Gallus Gallus)
  misc_feature (36): n=c or t
tgtgccctttggagggcagctcttggtgagatatanactgtacctattccttctgagatgtggtggggagt

SEQ ID NO: 41428 - DNA, 71 bp, chicken (Gallus Gallus)
  misc_feature (36): n=a or g
gttggaggacgttgtccaaaacccactgaagccaantgggaatcattccctctaatttagtagctttgggt

SEQ ID NO: 41429 - DNA, 71 bp, chicken (Gallus Gallus)
  misc_feature (36): n=a or g
atggacaagaaaaggaccataggagaggagacagcnctgctgaagtaggatgggaagcagaagttttctgg

SEQ ID NO: 41430 - DNA, 71 bp, chicken (Gallus Gallus)
  misc_feature (36): n=a or g
tctgcatagtcaatgtatccatcattgttcttatcntcatctcttaagacgtcatctattagactaattag

SEQ ID NO: 41431 - DNA, 71 bp, chicken (Gallus Gallus)
  misc_feature (36): n=c or t
gtatgaacaggagtctccttccctttttatttctangaatgttgcactgagagatcttaatcaaaactgcc

SEQ ID NO: 41432 - DNA, 71 bp, chicken (Gallus Gallus)
  misc_feature (36): n=c or t
gagcaacctgcctgcaggcgtcacatcttgatatgntcagaaaagcagatgtccttggattgaggtggcag

SEQ ID NO: 41433 - DNA, 71 bp, chicken (Gallus Gallus)
  misc_feature (36): n=c or t
gaggcctccaagtcatctcgttttgaatgtcagcgngcatggtacaaggctaattgagatacacagaaact

SEQ ID NO: 41434 - DNA, 71 bp, chicken (Gallus Gallus)
  misc_feature (36): n=c or t
ctgaaccctgttcttacagttaggaaatacacattngtgataagagaacgctggtaagatgcacggcgtta

SEQ ID NO: 41435 - DNA, 71 bp, chicken (Gallus Gallus)
  misc_feature (36): n=c or t
cacctcagaatctcaaatgctgattccagcaccccngccaaatccttctcatcctgtaccagttagaaacc

SEQ ID NO: 41436 - DNA, 71 bp, chicken (Gallus Gallus)
  misc_feature (36): n=c or t
tgaccaagtgatctcatcacagtccccaactccttngtagttatagtaccatcaccatccttgtcaaatag

SEQ ID NO: 41437 - DNA, 71 bp, chicken (Gallus Gallus)
  misc_feature (36): n=c or t
gctaataacagcagaattttagctaatctgtcatgnttttactaccaaggaaggaacatttaagccaagtt

SEQ ID NO: 41438 - DNA, 71 bp, chicken (Gallus Gallus)
  misc_feature (36): n=c or t
agaaagctaaatattcatgcacgctaaatagcgtgngtttctttaagagggtttgcttccctagcgctaat

SEQ ID NO: 41439 - DNA, 71 bp, chicken (Gallus Gallus)
  misc_feature (36): n=c or t
ttacgttttatggcagaaatggggaagttgatcatngctttacaggtaataggatgtgatcattggcagaa

SEQ ID NO: 41440 - DNA, 71 bp, chicken (Gallus Gallus)
  misc_feature (36): n=a or c
attaactaaaggttctaaaatgagtgaaatatttanatcacttaggctaagaccacctcattaaggaagcc

SEQ ID NO: 41441 - DNA, 71 bp, chicken (Gallus Gallus)
  misc_feature (36): n=a or g
ccatttcgcctcaagtaaccaaaaggaccacaggcntactgcacaccaatatgtcataaaaaataattatt

SEQ ID NO: 41442 - DNA, 71 bp, chicken (Gallus Gallus)
  misc_feature (36): n=a or g
caaagcttagtcatgagtctcacgcagcaaaggttnttgcggtacacggattttagtgaaaacaatcagaa

SEQ ID NO: 41443 - DNA, 71 bp, chicken (Gallus Gallus)
  misc_feature (36): n=c or t
ttttgacactgcagacaaagttaggtgctcataacngtggacagattattgcaccttgagagctcctgttt

SEQ ID NO: 41444 - DNA, 71 bp, chicken (Gallus Gallus)
  misc_feature (36): n=c or t
agcatacaacaagcacttgaacgctttgcaaatgcngcgtagttacacttctataaacgatacatgtagaa

SEQ ID NO: 41445 - DNA, 71 bp, chicken (Gallus Gallus)
  misc_feature (36): n=c or t
gaagggtcccaattcagtagtcacctttaagaaccnccttggcagaaactattccactgcagacaaaaaaa

SEQ ID NO: 41446 - DNA, 71 bp, chicken (Gallus Gallus)
  misc_feature (36): n=c or t
attaaacattaaggatccaaggacagtgaatgaaangaggtggccttctaggacacattcctcttcttgaa

SEQ ID NO: 41447 - DNA, 71 bp, chicken (Gallus Gallus)
  misc_feature (36): n=a or g
aggtttttccacagtactatggtgcatgcaacttcngtattgacagagttctgttcactggaattgttaaa

SEQ ID NO: 41448 - DNA, 71 bp, chicken (Gallus Gallus)
  misc_feature (36): n=g or t
atccctgtagaagagagcattaatattattcctttnaattactgtttcacaaacaaacaaacgaaataaat

SEQ ID NO: 41449 - DNA, 71 bp, chicken (Gallus Gallus)
  misc_feature (36): n=c or t
atgaaatagaggactgaccctctcatgagccaactngccatgtacacataacttgggacatgcttgcgaga

SEQ ID NO: 41450 - DNA, 71 bp, chicken (Gallus Gallus)
  misc_feature (36): n=a or g
atttgctacaaatgtgcctttaaacagagaacctgnagatgctaattacaacgctcacccagtcatttcct

SEQ ID NO: 41451 - DNA, 71 bp, chicken (Gallus Gallus)
  misc_feature (36): n=c or t
gttttttacatctttcatctttttcacggtcttatncatacatcattgcaaatttgtagaatgaggtgcct

SEQ ID NO: 41452 - DNA, 71 bp, chicken (Gallus Gallus)
  misc_feature (36): n=a or g
tctgtgactctgtgatccttctttgagcaggggtgnctttgtctctctaagcctttatccaccagaagtga

SEQ ID NO: 41453 - DNA, 71 bp, chicken (Gallus Gallus)
  misc_feature (36): n=c or t
ttcttcccccttgggataagaagtcctctacaaagnacatttgcgcaaccagcaagcagtccaagtttttt

SEQ ID NO: 41454 - DNA, 71 bp, chicken (Gallus Gallus)
  misc_feature (36): n=c or t
gtgctgtgaaacagtgagaggtgaaagcagaccttngagcattacttcaccctgcttttccctaaggatcc

SEQ ID NO: 41455 - DNA, 71 bp, chicken (Gallus Gallus)
  misc_feature (36): n=c or t
gtactcagcacctgagccgcacaagtagagctgcanagtcagcagcagagggaactctaataacagcctac

SEQ ID NO: 41456 - DNA, 71 bp, chicken (Gallus Gallus)
  misc_feature (36): n=a or c
ttgtattctgagtaatgcagacatgctggagggagnaggctctggcaccacaaggcatttggttgctgaag

SEQ ID NO: 41457 - DNA, 71 bp, chicken (Gallus Gallus)
  misc_feature (36): n=g or t
ttttcttctgagtggatgcttgaaaagagttgtgantctggcctgttgcggtcccaggatccatttgccta

SEQ ID NO: 41458 - DNA, 71 bp, chicken (Gallus Gallus)
  misc_feature (36): n=a or c
agaaatgcattgctgtgaaaatcagaatctagttanaatactcaatggtctcaattcctacttgtaatatg

SEQ ID NO: 41459 - DNA, 71 bp, chicken (Gallus Gallus)
  misc_feature (36): n=g or t
tgggtttcagacacctgctcagctctcctccactcnggagttagtgaaagaactctgaattgcttttattt

SEQ ID NO: 41460 - DNA, 71 bp, chicken (Gallus Gallus)
  misc_feature (36): n=a or g
ctgtgatgactgactggctccagtagagtgctgtanagtagcaacttttttagctaatatcttccctgtga

SEQ ID NO: 41461 - DNA, 71 bp, chicken (Gallus Gallus)
  misc_feature (36): n=c or t
actctcagttacttcaacatacagaacaggcacttnatctgctgcacgatgtctgacaatggagaaataga

SEQ ID NO: 41462 - DNA, 71 bp, chicken (Gallus Gallus)
  misc_feature (36): n=a or g
aaaataaacaacaaaaagatagaactaggagaaacnaagagaaaggtacactatactcccaactaactgca

SEQ ID NO: 41463 - DNA, 71 bp, chicken (Gallus Gallus)
  misc_feature (36): n=c or t
ttcagaaaagaatggtctaccaatttattgcttgangaatagactttttctacctgattgctgtaggtcca

SEQ ID NO: 41464 - DNA, 71 bp, chicken (Gallus Gallus)
  misc_feature (36): n=a or g
gttcccttgctttgctactgatcccaaataacacanaatcctcccatttaaaattttccaagaaacaaagc

SEQ ID NO: 41465 - DNA, 71 bp, chicken (Gallus Gallus)
  misc_feature (36): n=a or c
tattctatatattcatacatattctacataccaatnccacttacaaataaatgtcttttacaaacgtattt

SEQ ID NO: 41466 - DNA, 71 bp, chicken (Gallus Gallus)
  misc_feature (36): n=c or t
tgttttccctttctctttgaaactgctacaacctgngcatggacaatgtgatcctataaaactagggaatc

SEQ ID NO: 41467 - DNA, 71 bp, chicken (Gallus Gallus)
  misc_feature (36): n=g or t
ttctcaccctgaccttggatagtcacctcttggtgncacttgtaacacagtccccgctgcttatcccatca

SEQ ID NO: 41468 - DNA, 71 bp, chicken (Gallus Gallus)
  misc_feature (36): n=a or g
taaatgatccttgggagcaagaatctcatcttcctntctgcctccataacatcatgcacatgttcttactg

SEQ ID NO: 41469 - DNA, 71 bp, chicken (Gallus Gallus)
  misc_feature (36): n=c or t
ctccagaaataattcagtcagaaagtagcaacgctnagtgggcacactgctcccaaagaattgtaagaaca

SEQ ID NO: 41470 - DNA, 71 bp, chicken (Gallus Gallus)
  misc_feature (36): n=c or t
aagttgaaaatgtacccaaccataaaatagaagccnccaaagcatagaaacatgggtttttctcagtgaag

SEQ ID NO: 41471 - DNA, 71 bp, chicken (Gallus Gallus)
  misc_feature (36): n=g or t
cactcagcttagcccagttgaaggatttcagtgggngtgaaggctgcgggatagacttcttcttcaggctg

SEQ ID NO: 41472 - DNA, 71 bp, chicken (Gallus Gallus)
  misc_feature (36): n=a or c
atggaaattgcttctacaattatttatactcggatnccatctccctgtggcacatgatgaaaatgcgtttt

SEQ ID NO: 41473 - DNA, 71 bp, chicken (Gallus Gallus)
  misc_feature (36): n=a or g
tatttctggaggtaaactcagaggagtgagaaaagnaatgagagaaggagcatttcatacttctcttcaga

SEQ ID NO: 41474 - DNA, 71 bp, chicken (Gallus Gallus)
  misc_feature (36): n=a or g
ggatcaagggaatgttttcaaaccagctagttgccnaagtatccttttctgtttagggactgaaactgatg

SEQ ID NO: 41475 - DNA, 71 bp, chicken (Gallus Gallus)
  misc_feature (36): n=a or c
ttacaattgtaacaattcttcattccagtccactgnaactgaatttgaacagctcaccaaatctctatttt

SEQ ID NO: 41476 - DNA, 71 bp, chicken (Gallus Gallus)
  misc_feature (36): n=a or c
gtgatgcgagtgtgggaagcagtagttttgttcacntgcagacaaacatgttttatagctgcattatcgct

SEQ ID NO: 41477 - DNA, 71 bp, chicken (Gallus Gallus)
  misc_feature (36): n=c or t
agctgaggttagtttgtgttgtactagagtaaaggntgaaaagacaattcagaaaagacttctgcattttg

SEQ ID NO: 41478 - DNA, 71 bp, chicken (Gallus Gallus)
  misc_feature (36): n=a or c
agccacaccgaggcagaggctctgagctcagatatnagtgctgctctaaggctgttgcttctgtaccagaa

SEQ ID NO: 41479 - DNA, 71 bp, chicken (Gallus Gallus)
  misc_feature (36): n=c or t
gctacatatgatgattccttaccctgctaataatgntcatcctgctgcttgcttaatcatatgcacatgca

SEQ ID NO: 41480 - DNA, 71 bp, chicken (Gallus Gallus)
  misc_feature (36): n=a or g
acttgcctgtgaatcaatcctgcagtaataccacantgaagatcgaatacagttggtcctgtttgtcttag

SEQ ID NO: 41481 - DNA, 71 bp, chicken (Gallus Gallus)
  misc_feature (36): n=a or g
attgctggtattttcacacaatctggtattttagcngaagtaatgatttggatttgtgtctcatagatttt

SEQ ID NO: 41482 - DNA, 71 bp, chicken (Gallus Gallus)
  misc_feature (36): n=c or t
ttactcagaataaataaaagtgagttggaataaatntattgcaccaacaaacatgattgaaagtttaatat

SEQ ID NO: 41483 - DNA, 71 bp, chicken (Gallus Gallus)
  misc_feature (36): n=g or t
taaaactaaggcatccagtttttatgttatattcancaatgcagaagagtacattcttcctagagaacctg

SEQ ID NO: 41484 - DNA, 71 bp, chicken (Gallus Gallus)
  misc_feature (36): n=a or g
tagatgtttccctctcatcattaacagaaaaatatnagccttccttctgtgtatgtagtggttatgtgcat

SEQ ID NO: 41485 - DNA, 71 bp, chicken (Gallus Gallus)
  misc_feature (36): n=a or g
ttgtgccaaaacgttatatttctccctacaaataanaagaggccagaactattccttttttcataaatgaa

SEQ ID NO: 41486 - DNA, 71 bp, chicken (Gallus Gallus)
  misc_feature (36): n=a or g
aaaaaaaaatgcatactaaagtaaaaatgactcctnaaatgttttactttttgattcccactattggaact

SEQ ID NO: 41487 - DNA, 71 bp, chicken (Gallus Gallus)
  misc_feature (36): n=a or g
tacttttgtatccttatctattaaacaccaaacaantttactataaaatggcttacagaactaaatgtagc

SEQ ID NO: 41488 - DNA, 71 bp, chicken (Gallus Gallus)
  misc_feature (36): n=c or t
tgaatgtggttgttcatgattaatgcttctgttttncttcaagtacagctgttgaatgtattctacgcact

SEQ ID NO: 41489 - DNA, 71 bp, chicken (Gallus Gallus)
  misc_feature (36): n=c or t
aatctctctcttggcagatgagagagagaacacaangatgcttgggatctggaaggcacagtagtgtgtaa

SEQ ID NO: 41490 - DNA, 71 bp, chicken (Gallus Gallus)
  misc_feature (36): n=a or g
tgttgtggtgttgtgggtacctttcttagttctgtngcattgtgacttatgtatgagacttagtttctcta

SEQ ID NO: 41491 - DNA, 71 bp, chicken (Gallus Gallus)
  misc_feature (36): n=a or g
cagttattttcttaaaatgaaaactaaatggtagcngaggctttctacatgggaggaaaagttctatgatg

SEQ ID NO: 41492 - DNA, 71 bp, chicken (Gallus Gallus)
  misc_feature (36): n=c or t
tcatctttttttgatggcttttcctgcatatacaanatacaagcaagatgaacagctttccttaaaaatga

SEQ ID NO: 41493 - DNA, 71 bp, chicken (Gallus Gallus)
  misc_feature (36): n=c or t
aggtagaacagacaaaaaaacatatccttggatgcntgatctgtatggatgtccggtacctgcaggggtgt

SEQ ID NO: 41494 - DNA, 71 bp, chicken (Gallus Gallus)
  misc_feature (36): n=c or t
ttaatgacaccactaatatcacttttcttccttggngagtccttgcactgatacagtcatagtaagttaca

SEQ ID NO: 41495 - DNA, 71 bp, chicken (Gallus Gallus)
  misc_feature (36): n=a or g
cctctattcatttagatatatgagcacatcagagcnaacagaatttcgatatacttatgttctttccacat

SEQ ID NO: 41496 - DNA, 71 bp, chicken (Gallus Gallus)
  misc_feature (36): n=a or g
aatcagaagtcaaatgcacagcttactatatcatcntctacggaaaaacagctttgaacgatgcatatttc

SEQ ID NO: 41497 - DNA, 71 bp, chicken (Gallus Gallus)
  misc_feature (36): n=g or t
ggggtccctgcagcacatcgctgcaaggccccaganagcacactaggtgtaaaaactcatcaactatttcc

SEQ ID NO: 41498 - DNA, 71 bp, chicken (Gallus Gallus)
  misc_feature (36): n=g or t
tggacaatgcgttttcctgtaatgtttaggtatttnggggtacactggaagaaaagaggttgtgttatgac

SEQ ID NO: 41499 - DNA, 71 bp, chicken (Gallus Gallus)
  misc_feature (36): n=c or t
tatgttcttttagcagcctaagcatcactttggtancttaaaaacagagagaggctttgcactacttcctg

SEQ ID NO: 41500 - DNA, 71 bp, chicken (Gallus Gallus)
  misc_feature (36): n=a or g
caatctgctgcttatttggaaggacagaaggaaccnttaaattggctatatgagaacaggcaaaacaccaa

SEQ ID NO: 41501 - DNA, 71 bp, chicken (Gallus Gallus)
  misc_feature (36): n=g or t
tttcacaactggggaggtgcccagcaatgttctggngtcttcatcattgaagatcttcaaaacagcagcac

SEQ ID NO: 41502 - DNA, 71 bp, chicken (Gallus Gallus)
  misc_feature (36): n=g or t
gtaggaaatgttgagttaaaagcctgtggttccagngcgcaagaagtgggatgttgtgtgtgtgtcagcac

SEQ ID NO: 41503 - DNA, 71 bp, chicken (Gallus Gallus)
  misc_feature (36): n=a or g
gtttgtttttcccggtgtgaatgggaggtggtgccntgtgtctgcctcagatgttctgaaggtaaagctgg

SEQ ID NO: 41504 - DNA, 71 bp, chicken (Gallus Gallus)
  misc_feature (36): n=g or t
cgtagagttttgatggcatggtactgtcacatttgnccattttttggctgctgtcatcagtgcagagcatt

SEQ ID NO: 41505 - DNA, 71 bp, chicken (Gallus Gallus)
  misc_feature (36): n=g or t
tttcaccacaaaggtctgacaaaagaccatcttaantctgatcaagtttgatttgctccattctctgcaag

SEQ ID NO: 41506 - DNA, 71 bp, chicken (Gallus Gallus)
  misc_feature (36): n=a or g
ggctgttactttatggacactgttctttgtttagcnctctgaattgtaattaactttgaagaaatcagtat

SEQ ID NO: 41507 - DNA, 71 bp, chicken (Gallus Gallus)
  misc_feature (36): n=g or t
tccaggttagtgagtgaaggaagttggcaggcaggntctagtctggttattaggtttccagagacattaag

SEQ ID NO: 41508 - DNA, 71 bp, chicken (Gallus Gallus)
  misc_feature (36): n=c or t
cacaaggtagggctcttttccagctcagcaaactgncttattcaaaggtctctttcttcacattcatcatc

SEQ ID NO: 41509 - DNA, 71 bp, chicken (Gallus Gallus)
  misc_feature (36): n=g or t
accccggaaagaaacctccctctttcatggactttntgaggcactactctcagaggcagaagccagccctt

SEQ ID NO: 41510 - DNA, 71 bp, chicken (Gallus Gallus)
  misc_feature (36): n=a or g
cgattccctaacatgggctgatctggtggaacaagntatctgcacccaagacctgtaggcgaagcaatgca

SEQ ID NO: 41511 - DNA, 71 bp, chicken (Gallus Gallus)
  misc_feature (36): n=c or t
gggtgccaccagggtttggcgtgcgggtgaggaggngaacggagcggagcacggggtgcctcaaacgaaca

SEQ ID NO: 41512 - DNA, 71 bp, chicken (Gallus Gallus)
  misc_feature (36): n=a or g
cttcttcctcacacagtccccctctgcagatcctgnggcacttactttattctgaagatggctgtcaacca

SEQ ID NO: 41513 - DNA, 71 bp, chicken (Gallus Gallus)
  misc_feature (36): n=a or g
accttctctagaaatttccaaactcagggtcgtcanaggctcctaaccctgcaaaaatgggggcaaccaga

SEQ ID NO: 41514 - DNA, 71 bp, chicken (Gallus Gallus)
  misc_feature (36): n=a or g
caataagtgcccaggctgaaatgcagactgtaggcntggtagaaggaggctgggcattttatatgtaagtc

SEQ ID NO: 41515 - DNA, 71 bp, chicken (Gallus Gallus)
  misc_feature (36): n=c or t
gattagatgcacagataaagtttttcagatctcctntggcagggaaagcccggggctgaacacctttgata

SEQ ID NO: 41516 - DNA, 71 bp, chicken (Gallus Gallus)
  misc_feature (36): n=c or t
ttgaggcatctgtacctctgaagggacacatcctcngctcccgggctgtgggcagagccctctcattccag

SEQ ID NO: 41517 - DNA, 71 bp, chicken (Gallus Gallus)
  misc_feature (36): n=a or g
ttagttaatgtagtcctgcagagaccgtgttccagnattagaagtagactgttagtcaagcattacctgcg

SEQ ID NO: 41518 - DNA, 71 bp, chicken (Gallus Gallus)
  misc_feature (36): n=a or c
tcttgcactaaactctttgcttttatcattgcatcntttattcaacccaggtttaactccctttcttccca

SEQ ID NO: 41519 - DNA, 71 bp, chicken (Gallus Gallus)
  misc_feature (36): n=a or g
ccccgctagagccagttgctcactaaagcctctgancttcaattaacaagcaccaggtaatttaacacttg

SEQ ID NO: 41520 - DNA, 71 bp, chicken (Gallus Gallus)
  misc_feature (36): n=c or t
tagaaattctcccattggtatatgcaagatttactngaggcaggaatcctgccgacacttgtattgatgta

SEQ ID NO: 41521 - DNA, 71 bp, chicken (Gallus Gallus)
  misc_feature (36): n=c or t
aagcccaagaggaatgagtgcctttaagttcagaangctgggaggagggtaatttcaaagagggacttaga

SEQ ID NO: 41522 - DNA, 71 bp, chicken (Gallus Gallus)
  misc_feature (36): n=a or g
ctccatttggtgatgttgcaggccagagtacgttanctgctaaaagcacccttgaaactccttgcttatgg

SEQ ID NO: 41523 - DNA, 71 bp, chicken (Gallus Gallus)
  misc_feature (36): n=a or g
agtcggatacatccagactgcctccagacagccccnaggacagccccttttgctgctcagcattgtctttt

SEQ ID NO: 41524 - DNA, 71 bp, chicken (Gallus Gallus)
  misc_feature (36): n=c or t
aatgcgaccatctctgcacttcctacaggttctgcngatgtagtgttacacagtcaacagcatatgtgaaa

SEQ ID NO: 41525 - DNA, 71 bp, chicken (Gallus Gallus)
  misc_feature (36): n=c or t
cagtcaaccttcttttcaggagcactgataactttngagatgacagcatcagctatcacaatcggatttaa

SEQ ID NO: 41526 - DNA, 71 bp, chicken (Gallus Gallus)
  misc_feature (36): n=a or g
gggctgctgctgtctaggaatgccatgtgtatactntcaggcttgggctcaactactggagatatcataag

SEQ ID NO: 41527 - DNA, 71 bp, chicken (Gallus Gallus)
  misc_feature (36): n=c or t
ctgtgaatagatgtgtagtggtttgtcttaggtatngaaaagaagtcactgtgaccacctagttaaatact

SEQ ID NO: 41528 - DNA, 71 bp, chicken (Gallus Gallus)
  misc_feature (36): n=a or g
gagcaggtcctgcaactagcccctactcctccctangtgttggaaagagatcgcacaacccgtaaagtctc

SEQ ID NO: 41529 - DNA, 71 bp, chicken (Gallus Gallus)
  misc_feature (36): n=a or g
acctactccaaagagtaggaataaacataatgaatnaggcaaaattttattactttccttaatgaatatcg

SEQ ID NO: 41530 - DNA, 71 bp, chicken (Gallus Gallus)
  misc_feature (36): n=c or t
gcagaaagagaagcaacagggttacaattcaagttncttgtgaaaacaaaagatataaagtgaaaatacat

SEQ ID NO: 41531 - DNA, 71 bp, chicken (Gallus Gallus)
  misc_feature (36): n=a or g
agcaaatcagtaaaagctagactgccagtagtttgnagcttacaaccaattatttaatccaattagtcaga

SEQ ID NO: 41532 - DNA, 71 bp, chicken (Gallus Gallus)
  misc_feature (36): n=a or c
aaagccacacaaaaaaccactgattttgtcttttcngttaaaaccttcacacagccttgcagctacagaca

SEQ ID NO: 41533 - DNA, 71 bp, chicken (Gallus Gallus)
  misc_feature (36): n=a or g
atacggcaaatgctttacttgatggtagaaaggatnatagttatatattcctacaaagacatctctgtaga

SEQ ID NO: 41534 - DNA, 71 bp, chicken (Gallus Gallus)
  misc_feature (36): n=c or t
tgccagtgggagcaaggcagtgactccaagagaagnatccagctaatgtattaatgccttaatccagacca

SEQ ID NO: 41535 - DNA, 71 bp, chicken (Gallus Gallus)
  misc_feature (36): n=g or t
accctccttctcccttccattcatgcaggtcagtantatttgtggggaagctgcagatagatgatccacca

SEQ ID NO: 41536 - DNA, 71 bp, chicken (Gallus Gallus)
  misc_feature (36): n=c or t
tatatttcagttttgtgccaagcaccactcttgctntctccaaggcaagggacatatgggcatgttatcag

SEQ ID NO: 41537 - DNA, 71 bp, chicken (Gallus Gallus)
  misc_feature (36): n=a or g
gccccttaagttgcccgtaggttctcctttttacanttaacaactcagattcctgaagtactaatggatgt

SEQ ID NO: 41538 - DNA, 71 bp, chicken (Gallus Gallus)
  misc_feature (36): n=c or t
ctagcattcactgccacctacaatcagccagatagnggttgtatgtgacttcagtgaactattatccgttt

SEQ ID NO: 41539 - DNA, 71 bp, chicken (Gallus Gallus)
  misc_feature (36): n=c or t
taccatcacattctgtcaatgccagatgctatcccngttggccaggctatctggatgcagcaccaagaaat

SEQ ID NO: 41540 - DNA, 71 bp, chicken (Gallus Gallus)
  misc_feature (36): n=g or t
atcaacaggagtttggaaagattgtgggtgcatgtnatgaagataatgtaccagagaggggaaaatggcac

SEQ ID NO: 41541 - DNA, 71 bp, chicken (Gallus Gallus)
  misc_feature (36): n=g or t
ctgaagaacctcaaatgggttgttgcttctgctganataactgaaaagtgcagatacccatgtcctaagga

SEQ ID NO: 41542 - DNA, 71 bp, chicken (Gallus Gallus)
  misc_feature (36): n=a or g
ggtgaccgagacatagcatcttcattttaaaacctntgggatcctagatctgattgacctcagaaataaat

SEQ ID NO: 41543 - DNA, 71 bp, chicken (Gallus Gallus)
  misc_feature (36): n=a or g
tcatctgtggatctgaaacaaactttgaaattatcnatctggtcattaatcccaaataattttgtctgaaa

SEQ ID NO: 41544 - DNA, 71 bp, chicken (Gallus Gallus)
  misc_feature (36): n=c or t
gagcagccagagttcctttaagaagcatcataagcntgcatgatgggaacacagcatttctctgctgggct

SEQ ID NO: 41545 - DNA, 71 bp, chicken (Gallus Gallus)
  misc_feature (36): n=a or g
ctaagccagataaaagacagttccagataggccagngtgcaacagcagtggtgacaactgtatttatgggg

SEQ ID NO: 41546 - DNA, 71 bp, chicken (Gallus Gallus)
  misc_feature (36): n=a or c
ataaataaaacatctgcacatttagcattcctcgcnccaagtcttaatggggcagggaaggcaacaaccac

SEQ ID NO: 41547 - DNA, 71 bp, chicken (Gallus Gallus)
  misc_feature (36): n=c or t
ggagttcatgaaagggtgaagaaaagagtatgtganctgtgcattccaaaatgtgacataggccaaaaata

SEQ ID NO: 41548 - DNA, 71 bp, chicken (Gallus Gallus)
  misc_feature (36): n=a or g
caggaacaggaaggaaaactttacaacagatgatcngcctttgtgtttccttaagaagaaggaatccggaa

SEQ ID NO: 41549 - DNA, 71 bp, chicken (Gallus Gallus)
  misc_feature (36): n=c or t
ctctcagtgaaagacattgagaaaccctatctgtantacattaaggaattgtgaggggctagtgcaactct

SEQ ID NO: 41550 - DNA, 71 bp, chicken (Gallus Gallus)
  misc_feature (36): n=a or g
atgcataaagtcagcgatggtggtcatgccagctcntctcttgtgggagcaaagttagatttacaccaccc

SEQ ID NO: 41551 - DNA, 71 bp, chicken (Gallus Gallus)
  misc_feature (36): n=a or g
accgtgggtctgtgggttgtgttactgtagaagaanaggtgatggttgctgagaatgcccttcagctctcc

SEQ ID NO: 41552 - DNA, 71 bp, chicken (Gallus Gallus)
  misc_feature (36): n=c or t
tttgtaaatattagagcactttgaaaagatccagtntcttctcaggtgtttagagagaaaataatatgatt

SEQ ID NO: 41553 - DNA, 71 bp, chicken (Gallus Gallus)
  misc_feature (36): n=g or t
gggcaccttagttctctaaatatgttatatggctgngtacttgtgcagcatgtgaagttccactcaaatca

SEQ ID NO: 41554 - DNA, 71 bp, chicken (Gallus Gallus)
  misc_feature (36): n=c or t
tgctttctgggtgtctaagtggttactaccaaatcnacatataaaacaatggtcccactgcaggattttgg

SEQ ID NO: 41555 - DNA, 71 bp, chicken (Gallus Gallus)
  misc_feature (36): n=a or g
aaataaagcaggggatggttaacattattccattcncttttctaatagaaacaaaacattctcagtctctt

SEQ ID NO: 41556 - DNA, 71 bp, chicken (Gallus Gallus)
  misc_feature (36): n=c or t
tgatttatttccacttagaaagcactaaaatattcncgttgcaatattctcgaagcacatgcaagacaatg

SEQ ID NO: 41557 - DNA, 71 bp, chicken (Gallus Gallus)
  misc_feature (36): n=c or t
tgggaacctacctctttctgctgtgtgaagagatcncaggcactcaaagggtaggtgccagtgttatgtgc

SEQ ID NO: 41558 - DNA, 71 bp, chicken (Gallus Gallus)
  misc_feature (36): n=a or c
cagtgtgtctaaggtagattttgtccatgactcatntttgattgaagactgtaggaaccatttcagacctt

SEQ ID NO: 41559 - DNA, 71 bp, chicken (Gallus Gallus)
  misc_feature (36): n=a or g
aatagcatttcaagaaatggaataatgcttgtcacnttatcctgaatcatatcagggcagatcaaacagac

SEQ ID NO: 41560 - DNA, 71 bp, chicken (Gallus Gallus)
  misc_feature (36): n=c or t
atcctaacccaaatattaatgtttgtgcctcctgangtttcttatgagaaattaaattaatattactgtca

SEQ ID NO: 41561 - DNA, 71 bp, chicken (Gallus Gallus)
  misc_feature (36): n=a or g
cactaccaccacacattttgactgagaaagcagatncccacaacagtaggtgtacttcactcttactgtaa

SEQ ID NO: 41562 - DNA, 71 bp, chicken (Gallus Gallus)
  misc_feature (36): n=a or g
aagaaatcctaaaacaatttctagatcatactttcntctacaagaaaaatgtgaattatgcagtgaagaga

SEQ ID NO: 41563 - DNA, 71 bp, chicken (Gallus Gallus)
  misc_feature (36): n=a or g
gcaggctcacttcaggggtgtagactgccccgtctnttcagcatcccaatttttttagtcacatctcatga

SEQ ID NO: 41564 - DNA, 71 bp, chicken (Gallus Gallus)
  misc_feature (36): n=a or g
aagtgttagctgaaatgcataaacctctgcttcccnaagtgaagggttaatggggaaggagcagacaggcc

SEQ ID NO: 41565 - DNA, 71 bp, chicken (Gallus Gallus)
  misc_feature (36): n=a or g
taaatacgataattactagctgcctgtgagaccttntctcaatccccctgtgcattatggtgtttttattt

SEQ ID NO: 41566 - DNA, 71 bp, chicken (Gallus Gallus)
  misc_feature (36): n=a or g
gttctaatacatattatccagtcatccagctctcantctgatgcttctctctgtcttgatcccatactcaa

SEQ ID NO: 41567 - DNA, 71 bp, chicken (Gallus Gallus)
  misc_feature (36): n=a or g
aaccgggatctagaagcttcctgtagaaaacaaagnagaattaatcgtcataacgtacactggagaataac

SEQ ID NO: 41568 - DNA, 71 bp, chicken (Gallus Gallus)
  misc_feature (36): n=a or c
tgtagccacaactggtcccctgattacagccagctntactgtaccaataatgcctcataacagcaggagga

SEQ ID NO: 41569 - DNA, 71 bp, chicken (Gallus Gallus)
  misc_feature (36): n=a or c
agtaacggccccacaacggccatttatggacactancagatggacgttaggaattagcgcagccgctgcgc

SEQ ID NO: 41570 - DNA, 71 bp, chicken (Gallus Gallus)
  misc_feature (36): n=c or t
gacgtttaatacttttaaggagatattagctgtagntttcttctaaagttaactttcacatttttaggagc

SEQ ID NO: 41571 - DNA, 71 bp, chicken (Gallus Gallus)
  misc_feature (36): n=c or t
cagtgcgtctctacacatccctattacagcatcccngagaatccctgtgcatccctgcacatccctactac

SEQ ID NO: 41572 - DNA, 71 bp, chicken (Gallus Gallus)
  misc_feature (36): n=a or g
attgggttgtgctcaaactccttgcaatcacaccgnggcaataaagaacagactatcagcgtgcggtgata

SEQ ID NO: 41573 - DNA, 71 bp, chicken (Gallus Gallus)
  misc_feature (36): n=a or g
actatcctgtatctgagtagacttgagcatggtgtnttcctgtttgctgacttatccttacatacttgtgt

SEQ ID NO: 41574 - DNA, 71 bp, chicken (Gallus Gallus)
  misc_feature (36): n=a or g
accctggttttcttaaaattgtagaactttttaaangcagcaatagcaaatggctacatttgagcatgacg

SEQ ID NO: 41575 - DNA, 71 bp, chicken (Gallus Gallus)
  misc_feature (36): n=a or g
cagctccatattcattagataagatgatggcagtcngtcgtaatttctgcctttgctgaattgctctgcag

SEQ ID NO: 41576 - DNA, 71 bp, chicken (Gallus Gallus)
  misc_feature (36): n=c or t
tctgatccaattaacttgagcaaacaaccgctttcngatgtattttctgcaaccactggctgtaaaatatg

SEQ ID NO: 41577 - DNA, 71 bp, chicken (Gallus Gallus)
  misc_feature (36): n=a or g
cctggagagcttggaaaagtgataatattaaatatngagaactaatcatggcaaatgaacacaatccttag

SEQ ID NO: 41578 - DNA, 71 bp, chicken (Gallus Gallus)
  misc_feature (36): n=c or t
gcagtatttgttatttttgttaggctcatgcaccanataaatggcatggcttataaacaacaatattaaca

SEQ ID NO: 41579 - DNA, 71 bp, chicken (Gallus Gallus)
  misc_feature (36): n=g or t
gaaaggcagaacagtaaagcagaacccataaaaaancatggatctttcccaggatggatgcccaccgagga

SEQ ID NO: 41580 - DNA, 71 bp, chicken (Gallus Gallus)
  misc_feature (36): n=c or t
atgtctaaggctgttctcaaccagaaaattggatcnttgttcttctactttgtctgtttttacagacattg

SEQ ID NO: 41581 - DNA, 71 bp, chicken (Gallus Gallus)
  misc_feature (36): n=a or c
ctcaccttggggtgtggtgagaacagagttgatctnatttgtaagagattccaatgggagcaagaagtatg

SEQ ID NO: 41582 - DNA, 71 bp, chicken (Gallus Gallus)
  misc_feature (36): n=a or g
tattggtgagatctcaactgattctcagagtggccngtctcaaggaagagggtgaagttatctgtgggaca

SEQ ID NO: 41583 - DNA, 71 bp, chicken (Gallus Gallus)
  misc_feature (36): n=c or t
gttctgtcttcggtcatttgtgttcagagctctccncttgattgatctaaaaagagctcacttgagaaagc

SEQ ID NO: 41584 - DNA, 71 bp, chicken (Gallus Gallus)
  misc_feature (36): n=a or g
tgcaactaagcaaagccctgatgtcttatttcttcngagcttttttttttcccctttgtttttcttactcc

SEQ ID NO: 41585 - DNA, 71 bp, chicken (Gallus Gallus)
  misc_feature (36): n=a or c
cgagacagttcgccaaactctgaagtgagacacttncagtgaccttacatcacacagaaggtttctaagtc

SEQ ID NO: 41586 - DNA, 71 bp, chicken (Gallus Gallus)
  misc_feature (36): n=a or g
tgagatcaagatccccacggtggttggggttggacnagaatacgatcttggctgtctgtgatcaaggacag

SEQ ID NO: 41587 - DNA, 71 bp, chicken (Gallus Gallus)
  misc_feature (36): n=a or g
ctgctgggggaaggtgagcagcaaagccacagtgangtcagaactggaaaacacccatcctggaaattcgt

SEQ ID NO: 41588 - DNA, 71 bp, chicken (Gallus Gallus)
  misc_feature (36): n=c or t
tggttaccaaagactacataatgatattacacatgngaagcacagtaaaagattgttatacaggttgcaaa

SEQ ID NO: 41589 - DNA, 71 bp, chicken (Gallus Gallus)
  misc_feature (36): n=a or c
atcttcccgtacagcagctgagtttcacgccaggcngagtgttgcataccttgcccttggtcctatgtgtg

SEQ ID NO: 41590 - DNA, 71 bp, chicken (Gallus Gallus)
  misc_feature (36): n=a or g
gttaaatatgaatgttaggaatggaaaagtattttnaaatcacttaattgcaagttcatggaataccggca

SEQ ID NO: 41591 - DNA, 71 bp, chicken (Gallus Gallus)
  misc_feature (36): n=a or g
tcctgctccattgaaaaggctttcttaattattttnggttaaaacagagttttcaattctacactcttcaa

SEQ ID NO: 41592 - DNA, 71 bp, chicken (Gallus Gallus)
  misc_feature (36): n=c or t
gtacatgtgtgtgctgtaccaccgtgccactgattnttatcatttctgctcgaggttgagtacatctctgt

SEQ ID NO: 41593 - DNA, 71 bp, chicken (Gallus Gallus)
  misc_feature (36): n=a or g
gaacaacaatacgaacaattcaggcatccaaagacnccaaatccttttttgaccacatgaagtatgcagaa

SEQ ID NO: 41594 - DNA, 71 bp, chicken (Gallus Gallus)
  misc_feature (36): n=c or t
gtcagcagatgaatttgccatgaaacttgacacgangttcattgttcttgccagacacaggctccttcagg

SEQ ID NO: 41595 - DNA, 71 bp, chicken (Gallus Gallus)
  misc_feature (36): n=a or g
ggatatgcagcacagataccttgccttttacttcancaatgtttccatattttggatgattgttgtaggcc

SEQ ID NO: 41596 - DNA, 71 bp, chicken (Gallus Gallus)
  misc_feature (36): n=a or g
agtggagctggaaggaccaacaggttgacctggcancctttaatgcacaaacaataaatcaatccctgcct

SEQ ID NO: 41597 - DNA, 71 bp, chicken (Gallus Gallus)
  misc_feature (36): n=g or t
ttacttttctctttgtatgattgtcaaaagtgatangtatgttgaaaagaaacctttttctctgctactgt

SEQ ID NO: 41598 - DNA, 71 bp, chicken (Gallus Gallus)
  misc_feature (36): n=g or t
tctcagaagaatctagaggatctacttctcgcaaangtaccaactccctttgcacagctttaattcttaag

SEQ ID NO: 41599 - DNA, 71 bp, chicken (Gallus Gallus)
  misc_feature (36): n=c or t
caactatgtgatatggaaaataaaattgccctctcngcagatcttatttcccatcttgaaggtaaagcaaa

SEQ ID NO: 41600 - DNA, 71 bp, chicken (Gallus Gallus)
  misc_feature (36): n=a or g
ttagcagagaataattaatatcttcataatgacacntgtgttagttacaaacactcatttcacccttaacg

SEQ ID NO: 41601 - DNA, 71 bp, chicken (Gallus Gallus)
  misc_feature (36): n=c or t
ttttccatgatttctatcacagatccacttagttcntttacaaagacatttgggggaattatatcaagaac

SEQ ID NO: 41602 - DNA, 71 bp, chicken (Gallus Gallus)
  misc_feature (36): n=c or t
taactaaaagaagtgctttgagtttgcaaacactantgattagaagataagactgtgtattatgatacaaa

SEQ ID NO: 41603 - DNA, 71 bp, chicken (Gallus Gallus)
  misc_feature (36): n=c or t
aataaataattataggcagctaaaggatttgttcgntcctaaaggtctccccttcacatttctcagaggtt

SEQ ID NO: 41604 - DNA, 71 bp, chicken (Gallus Gallus)
  misc_feature (36): n=c or t
cttatatgtcaaaaacatcacatacactacaactantcaggaaaattcaatgactaatacggacataactc

SEQ ID NO: 41605 - DNA, 71 bp, chicken (Gallus Gallus)
  misc_feature (36): n=a or c
gggcattgttcatgtcattttcctgtatttagagtnagagattcctcaggtacgatgaaagatataaaaaa

SEQ ID NO: 41606 - DNA, 71 bp, chicken (Gallus Gallus)
  misc_feature (36): n=g or t
caggttgccattcagggcaaactgtactgcgaactntttaggagagatttgattttgaagttcgtgtaggg

SEQ ID NO: 41607 - DNA, 71 bp, chicken (Gallus Gallus)
  misc_feature (36): n=c or t
tgcatatccatcctcttgcaaagacataccaacacnaccttggctttatggccaccattcaaaactgacca

SEQ ID NO: 41608 - DNA, 71 bp, chicken (Gallus Gallus)
  misc_feature (36): n=a or g
tgaagcagattttagctgttatggatgacttcatcngtacaagatccatttgttaattcctgtgagtgttt

SEQ ID NO: 41609 - DNA, 71 bp, chicken (Gallus Gallus)
  misc_feature (36): n=a or g
ttactgacttctttgagaaagcagcaagagaccgangagacaactcttacagatctgaatatgaatccata

SEQ ID NO: 41610 - DNA, 71 bp, chicken (Gallus Gallus)
  misc_feature (36): n=c or t
gattggaaaaaataaataaaactgttctgggttatngttctactaccatactagttttcctgttcagatac

SEQ ID NO: 41611 - DNA, 71 bp, chicken (Gallus Gallus)
  misc_feature (36): n=g or t
tattaatgttcaatcaaccagtaaatcctgataccngtaggtgagcaggtataaggggaatgaatggcact

SEQ ID NO: 41612 - DNA, 71 bp, chicken (Gallus Gallus)
  misc_feature (36): n=g or t
ctgcaacacggaaagtggttaaggtgtatcgaaagnggatactgcaggagaagcctgtgttcatggaggag

SEQ ID NO: 41613 - DNA, 71 bp, chicken (Gallus Gallus)
  misc_feature (36): n=c or t
atctctactactactaacaagaagatcccactctanaactagaaaataaacataccataagtgatttttca

SEQ ID NO: 41614 - DNA, 71 bp, chicken (Gallus Gallus)
  misc_feature (36): n=a or g
ctgctgtaattttattctccttagtatcatgaaagnaacagtcatctccaaatattcatggagcttaattt

SEQ ID NO: 41615 - DNA, 71 bp, chicken (Gallus Gallus)
  misc_feature (36): n=a or g
aatgctgacttctttctgtctaaatgtacaccttcngtttgagaagagctacagtgaaagttggatgctca

SEQ ID NO: 41616 - DNA, 71 bp, chicken (Gallus Gallus)
  misc_feature (36): n=c or t
tttttccacaaggaggtggtatgctctggagcagantgcaatcttggtttctgtttctgttgcctagtgaa

SEQ ID NO: 41617 - DNA, 71 bp, chicken (Gallus Gallus)
  misc_feature (36): n=a or g
aataaacagcagacagagaacacgaatgtctcccantaggagtgtcagatataaaaagccattgtgcccat

SEQ ID NO: 41618 - DNA, 71 bp, chicken (Gallus Gallus)
  misc_feature (36): n=a or g
gcagtgatgcagctcccttttcaaaacaagccagcntttgttaggtcaatgaacagagttggcagtgccct

SEQ ID NO: 41619 - DNA, 71 bp, chicken (Gallus Gallus)
  misc_feature (36): n=c or t
ccctaccaaccacagcgattgttctgattttatctngctcctgccaggcgaggaacacgttttcttggcta

SEQ ID NO: 41620 - DNA, 71 bp, chicken (Gallus Gallus)
  misc_feature (36): n=g or t
atgggtctggggcagcgtcactgcgggaccctccancaggggggagaagtgatggaacggagaagtgattt

SEQ ID NO: 41621 - DNA, 71 bp, chicken (Gallus Gallus)
  misc_feature (36): n=a or g
attagacagtggcagtacacaggataagactaatcnggattatttgtgaattcccagttacatttttgtac

SEQ ID NO: 41622 - DNA, 71 bp, chicken (Gallus Gallus)
  misc_feature (36): n=a or g
tgggtgttggggcattagtgatgcgggtgagtgcangagggatgactgatttttgcagctctgctagtgat

SEQ ID NO: 41623 - DNA, 71 bp, chicken (Gallus Gallus)
  misc_feature (36): n=c or t
ggcttgtgggcttgtggagtttgttttggtggcctngcttattcaaaacttagttatgtagaagctggggt

SEQ ID NO: 41624 - DNA, 71 bp, chicken (Gallus Gallus)
  misc_feature (36): n=g or t
tctgtgcataatcttcatcattaaaacagtggctgngaagaaagaatatctgtaagtgacatttcagcagc

SEQ ID NO: 41625 - DNA, 71 bp, chicken (Gallus Gallus)
  misc_feature (36): n=a or c
ccagatgatgcagtattagtttaattgttcatatanaagaggtgctgccccacataaattcttcatctttc

SEQ ID NO: 41626 - DNA, 71 bp, chicken (Gallus Gallus)
  misc_feature (36): n=a or g
gttgaagaatttgaagccctgacaccagttattgantcgagccttcaacaagtggaaaacatgcatggcac

SEQ ID NO: 41627 - DNA, 71 bp, chicken (Gallus Gallus)
  misc_feature (36): n=g or t
atgtgaagcgagttcagttgcaatagaaggatacantccttggaatttttgttctcacttattctatgtcc

SEQ ID NO: 41628 - DNA, 71 bp, chicken (Gallus Gallus)
  misc_feature (36): n=c or t
ttgtttgtaactctctacttcttaagtagcctcacncatcaagctaggtaaaatcattcttgtgcgatgcg

SEQ ID NO: 41629 - DNA, 71 bp, chicken (Gallus Gallus)
  misc_feature (36): n=a or g
agaaaataatcagtctgcagatttatacagactccncaagtgtgaaaggagttcaccagaaaatataaagg

SEQ ID NO: 41630 - DNA, 71 bp, chicken (Gallus Gallus)
  misc_feature (36): n=a or c
gaaggcctgtctgcatctgcacctgagcaactgcancagtggcagagattaatcatcactttgcttttctc

SEQ ID NO: 41631 - DNA, 71 bp, chicken (Gallus Gallus)
  misc_feature (36): n=c or t
ctacatggcttggtacacagtatacagataagatcngaaatgatgcagggaacatgacatagaaatgagtt

SEQ ID NO: 41632 - DNA, 71 bp, chicken (Gallus Gallus)
  misc_feature (36): n=a or g
taaaaatgagaaatgttttatgaagatggcaagggnagagaagagagtgactaaaattagtctgaggccac

SEQ ID NO: 41633 - DNA, 71 bp, chicken (Gallus Gallus)
  misc_feature (36): n=g or t
ttttgtgtaactggttataaaatctaggagttatcnacacaaggttaaaaatacatagatttgatgctact

SEQ ID NO: 41634 - DNA, 71 bp, chicken (Gallus Gallus)
  misc_feature (36): n=a or g
ttagttggagagccatttcatgctgagtactgacangagcatagagtgacttgaagttagttatttctgca

SEQ ID NO: 41635 - DNA, 71 bp, chicken (Gallus Gallus)
  misc_feature (36): n=a or g
ttcttttcctaaggtattatctcttgtgtaaatccncaggatatgttagctggatgatattgggggaaggg

SEQ ID NO: 41636 - DNA, 71 bp, chicken (Gallus Gallus)
  misc_feature (36): n=a or g
attatacatttgtcacgcatcttgtagtcagtaccntgagcaccttaacagaattcaggactggaaatgac

SEQ ID NO: 41637 - DNA, 71 bp, chicken (Gallus Gallus)
  misc_feature (36): n=c or t
ttgctttgttgatctggtgcatgttcttgcattgangaatctttggcaaccatccagcgttacatatctta

SEQ ID NO: 41638 - DNA, 71 bp, chicken (Gallus Gallus)
  misc_feature (36): n=a or g
cctagttatgacaccacgtctgcaaaactatacagntccaggcactgcaaaaagagcctctctactttcac

SEQ ID NO: 41639 - DNA, 71 bp, chicken (Gallus Gallus)
  misc_feature (36): n=a or c
acagacactctgatttcccctgttgctagcaccccncacacagtggcctttatgactcccgatgccctcac

SEQ ID NO: 41640 - DNA, 71 bp, chicken (Gallus Gallus)
  misc_feature (36): n=c or t
tgatgggctgtctcagaaggatattctttgtttgancttgagtgtggggagcaaactgctgttgttagtat

SEQ ID NO: 41641 - DNA, 71 bp, chicken (Gallus Gallus)
  misc_feature (36): n=c or t
gtgcaccacttctgtatgtcctctcaaagaggttantgccgtcatctcgggatctgcaacaaaaagaagga

SEQ ID NO: 41642 - DNA, 71 bp, chicken (Gallus Gallus)
  misc_feature (36): n=g or t
gctttttttcaggatggtgtacttcctcttgttctnttttcagtatggtactgtgtcaggtacattctttg

SEQ ID NO: 41643 - DNA, 71 bp, chicken (Gallus Gallus)
  misc_feature (36): n=a or g
ttcaaaacatctgatgtctaattgttcacatgaatntttcattatttcatagcagagctgttgccctgaaa

SEQ ID NO: 41644 - DNA, 71 bp, chicken (Gallus Gallus)
  misc_feature (36): n=a or g
attatctcttgacactgaagtaagctttgataaacntaagaaatactctgtcttatataatcagcaaggtt

SEQ ID NO: 41645 - DNA, 71 bp, chicken (Gallus Gallus)
  misc_feature (36): n=c or t
tgataaagttgcctttggagttctcacatctgtaangctgtatgctgtgcaggacaaagcagactttcact

SEQ ID NO: 41646 - DNA, 71 bp, chicken (Gallus Gallus)
  misc_feature (36): n=a or g
gtaagtcgtatgcagtctaaggctgagctgaagttntactcaccctgttactactaaaatatctgacagca

SEQ ID NO: 41647 - DNA, 71 bp, chicken (Gallus Gallus)
  misc_feature (36): n=a or g
ttgcaaattttcagcattccagataatcacagagcntacttagtttgacagccctttgttacaaaggcaca

SEQ ID NO: 41648 - DNA, 71 bp, chicken (Gallus Gallus)
  misc_feature (36): n=c or t
acaaaaagcatggaagtaggaatgtgctttggctgnaattatgggaactcaagctggctggaaccacaact

SEQ ID NO: 41649 - DNA, 71 bp, chicken (Gallus Gallus)
  misc_feature (36): n=c or t
gagaaaattcattaacatactaatgatgtgtcctanttaaaattccagctctgattattgtgtgattaagt

SEQ ID NO: 41650 - DNA, 71 bp, chicken (Gallus Gallus)
  misc_feature (36): n=g or t
agtcctctgggctgatttcactgggcgtaataggtntgcatttgcatttggctttgaattttccgcccttt

SEQ ID NO: 41651 - DNA, 71 bp, chicken (Gallus Gallus)
  misc_feature (36): n=a or g
ttcatgtgtctgatcagtgagttgcattgtgagtcngtatttcaatacctaaagatctcaagggtcataca

SEQ ID NO: 41652 - DNA, 71 bp, chicken (Gallus Gallus)
  misc_feature (36): n=a or g
ggttttcctttggaaacacatcttctccacatcacnttattggacctgcagagcaaccagcggttggaggt

SEQ ID NO: 41653 - DNA, 71 bp, chicken (Gallus Gallus)
  misc_feature (36): n=a or g
gctgcttcctgtaagctgcttgtcctctgccttctntcagcagtcatgcactgaatcatgaaaaaactgag

SEQ ID NO: 41654 - DNA, 71 bp, chicken (Gallus Gallus)
  misc_feature (36): n=g or t
cagtccctgtggttatgtcagaaggcatttcctccntagatgttaatattgcttttattcctgtggctgtc

SEQ ID NO: 41655 - DNA, 71 bp, chicken (Gallus Gallus)
  misc_feature (36): n=a or g
agcacaatacctgtgaacacaaagagcagctatctnaggagcagcccacaaacagacctgcactgcggagg

SEQ ID NO: 41656 - DNA, 71 bp, chicken (Gallus Gallus)
  misc_feature (36): n=a or g
aatttcctgagccaagaatacaacttgatcctgagnaggcaagccaagcctgaaaggctgagagcttgaaa

SEQ ID NO: 41657 - DNA, 71 bp, chicken (Gallus Gallus)
  misc_feature (36): n=c or t
agaggagaatctgaaccatgggatggagatatcagngcaataaatgatctcgcctaccccacagcacactg

SEQ ID NO: 41658 - DNA, 71 bp, chicken (Gallus Gallus)
  misc_feature (36): n=a or g
cagatctgactagtttctgcaaagtctttgtaccantgttttagcagagagctgcctggaggaaagggcaa

SEQ ID NO: 41659 - DNA, 71 bp, chicken (Gallus Gallus)
  misc_feature (36): n=a or g
tttttaacctggagccttttgttgttgctcaggttntggtattaattgaggcacacagcactgtatgtctc

SEQ ID NO: 41660 - DNA, 71 bp, chicken (Gallus Gallus)
  misc_feature (36): n=a or g
tttgggaagagcctttacaagaagaaatatataccnagtagcactggcaacaggcttacatctgagcaggt

SEQ ID NO: 41661 - DNA, 71 bp, chicken (Gallus Gallus)
  misc_feature (36): n=a or g
tggtttatgccctgtaagttaatacaatcctgtccntttccatcactgctaacctttagaatacaaagggt

SEQ ID NO: 41662 - DNA, 71 bp, chicken (Gallus Gallus)
  misc_feature (36): n=g or t
acacagcacagttagcatactcacagcaaccgaaanagcactgaagtaaagctcttccttcattcctatag

SEQ ID NO: 41663 - DNA, 71 bp, chicken (Gallus Gallus)
  misc_feature (36): n=a or g
gaagcccacagcattcccctcaccttctgtaattanttacttgtgttatttaacagttagcagtctgcaga

SEQ ID NO: 41664 - DNA, 71 bp, chicken (Gallus Gallus)
  misc_feature (36): n=c or t
ccaaacatgctacatgacccagtggtctgagtatanccaggtgggatcatcactaccacgcagggcttgct

SEQ ID NO: 41665 - DNA, 71 bp, chicken (Gallus Gallus)
  misc_feature (36): n=a or c
aatgacacacacagtatttctatgaggagttcttgnaactgccaagatgggcacattttttttcacaaata

SEQ ID NO: 41666 - DNA, 71 bp, chicken (Gallus Gallus)
  misc_feature (36): n=c or t
ctccaggacagtgttttgctgtctaatgtgagatgngatgtggagggcagcaaaagcacaacaggatatga

SEQ ID NO: 41667 - DNA, 71 bp, chicken (Gallus Gallus)
  misc_feature (36): n=a or g
agtaaaaatctctgcacttaagtgaaaattcatgcntttaagacaaaaacaccccagcttgttttctgccc

SEQ ID NO: 41668 - DNA, 71 bp, chicken (Gallus Gallus)
  misc_feature (36): n=c or t
tggaagcagcaggctcctgctggtgcagggaagagngtgaccctgcagcaaaacttcaggcacttttaacc

SEQ ID NO: 41669 - DNA, 71 bp, chicken (Gallus Gallus)
  misc_feature (36): n=c or t
tgttgttatatttttaatcaatatgaggtgtgtgantgaaaaagctctagcctaaaataatgatatttaga

SEQ ID NO: 41670 - DNA, 71 bp, chicken (Gallus Gallus)
  misc_feature (36): n=a or g
tgggaaaagacaggtgttgtgaagcagacttctctnttgctttctttgcctggaaacagacaaaagcttgg

SEQ ID NO: 41671 - DNA, 71 bp, chicken (Gallus Gallus)
  misc_feature (36): n=a or c
gctaagggtttggcttaggctgtagaatatactacnttgaaggacagtcagactgaggcaggacaggtatt

SEQ ID NO: 41672 - DNA, 71 bp, chicken (Gallus Gallus)
  misc_feature (36): n=g or t
ctggctgagaagcagaatcacagcagtgcccagacngcaggttaaccacacactgggtacagacacatcca

SEQ ID NO: 41673 - DNA, 71 bp, chicken (Gallus Gallus)
  misc_feature (36): n=c or t
tcgctattacaacaaaaaccgtgatttattatctcnttctgcttgctttggagcaccttgtgaaggctgag

SEQ ID NO: 41674 - DNA, 71 bp, chicken (Gallus Gallus)
  misc_feature (36): n=a or g
agcaaaactgaatttcttaaatacgttcctgaaccnaagaagtagttgtgcatttggaaggcgagatcatt

SEQ ID NO: 41675 - DNA, 71 bp, chicken (Gallus Gallus)
  misc_feature (36): n=c or t
agcgtttttgctagaatttgaagcttcttctggaanccagcactgtgttattatttgcatgtcatattcag

SEQ ID NO: 41676 - DNA, 71 bp, chicken (Gallus Gallus)
  misc_feature (36): n=c or t
tctcagcagattttcccatttatgtcagccctgctntttctgcattctaacaagagcattcacagttttat

SEQ ID NO: 41677 - DNA, 71 bp, chicken (Gallus Gallus)
  misc_feature (36): n=a or g
ttttttttaactgagctttaagctggtaatcaggtntaatgtacttaattgtagaaagaagcttcccggga

SEQ ID NO: 41678 - DNA, 71 bp, chicken (Gallus Gallus)
  misc_feature (36): n=c or t
ctgtactgtagcttattaatggtccagttccagccngggttctgaaaatgttggcctcatctgtggtaaaa

SEQ ID NO: 41679 - DNA, 71 bp, chicken (Gallus Gallus)
  misc_feature (36): n=a or g
aattccccacataagatatagttcagttgtatgggnaaagtaaagtgactaagactatttcagagcacagg

SEQ ID NO: 41680 - DNA, 71 bp, chicken (Gallus Gallus)
  misc_feature (36): n=g or t
tgattgtctaagaagcactaaaattgcaaagacatncaggaacattgtggtgtatattctgggatcagatc

SEQ ID NO: 41681 - DNA, 71 bp, chicken (Gallus Gallus)
  misc_feature (36): n=a or g
atggaggagaatatgcatgtgcccaggtcaaactgnctcagtgccagggtttgttaaaagattaacaaatc

SEQ ID NO: 41682 - DNA, 71 bp, chicken (Gallus Gallus)
  misc_feature (36): n=c or t
ggctttagagaaagctacagctaaaaactttttttnactttggcaaggacaagtcattattaatttcagaa

SEQ ID NO: 41683 - DNA, 71 bp, chicken (Gallus Gallus)
  misc_feature (36): n=a or g
atgacagtgtcttcttgacttcttgtcaatttcagngtgctctctcctacccagaaggtgaggcagactgt

SEQ ID NO: 41684 - DNA, 71 bp, chicken (Gallus Gallus)
  misc_feature (36): n=a or g
tttagtggttaagccagcagtggaccatttgtggtntggatggcagctacaaggctgcaaagggatacagt

SEQ ID NO: 41685 - DNA, 71 bp, chicken (Gallus Gallus)
  misc_feature (36): n=a or g
actccaaaacagacaaatgtgtcagacagcagatcnctcaccagtacaatgagcttataacacatcctcac

SEQ ID NO: 41686 - DNA, 71 bp, chicken (Gallus Gallus)
  misc_feature (36): n=c or t
tgatatgaaattaagtaatcagttgcaattctactntgttaacaacttctaaatgacaatcccctaaactg

SEQ ID NO: 41687 - DNA, 71 bp, chicken (Gallus Gallus)
  misc_feature (36): n=c or t
tattacagcacaaattcaagtggcattcaagttgangtatcctgaaaagctagcatactttaaagggccaa

SEQ ID NO: 41688 - DNA, 71 bp, chicken (Gallus Gallus)
  misc_feature (36): n=a or g
aataaattcagacaatacaaataaagaagtctgtgncactttcattaagtgggtagatacctaaggcagca

SEQ ID NO: 41689 - DNA, 71 bp, chicken (Gallus Gallus)
  misc_feature (36): n=a or g
tgattggctcagcccaacaatgaaggctgactgggnattaaaaagaaggtcacagatgcatgactttattt

SEQ ID NO: 41690 - DNA, 71 bp, chicken (Gallus Gallus)
  misc_feature (36): n=c or t
tcttatatacaccttccttaaatacatctatggcantttattacacccctctcaagtaaatgtgattaaca

SEQ ID NO: 41691 - DNA, 71 bp, chicken (Gallus Gallus)
  misc_feature (36): n=c or t
agcattctgtgcacacctataccagcctccttgtcnataccacttgaataccaaaattacttaatcactta

SEQ ID NO: 41692 - DNA, 71 bp, chicken (Gallus Gallus)
  misc_feature (36): n=a or g
ctggccatgttgtgggagaggcagagcaaagcagangagttacaaacctaagagagcacttcatgctgtag

SEQ ID NO: 41693 - DNA, 71 bp, chicken (Gallus Gallus)
  misc_feature (36): n=c or t
gtccagacttttcaagtaaacagggagatatttcanggctttttaatgcagaggtatttttccacatggca

SEQ ID NO: 41694 - DNA, 71 bp, chicken (Gallus Gallus)
  misc_feature (36): n=c or t
gcagaaactgggattcagctgcacagtatgatctcnagggcaagctgaaccaatagataagcttcatctgg

SEQ ID NO: 41695 - DNA, 71 bp, chicken (Gallus Gallus)
  misc_feature (36): n=a or g
ctcttccctggtgaggtgttgtcctgccagttggcnttgtgcttctgccaagggagcagtgagatgttttc

SEQ ID NO: 41696 - DNA, 71 bp, chicken (Gallus Gallus)
  misc_feature (36): n=a or g
tggaatgttagtttggtcactcaggcctgattttcngaggcactgaacacagaaaattcccccccagattt

SEQ ID NO: 41697 - DNA, 71 bp, chicken (Gallus Gallus)
  misc_feature (36): n=a or g
gtatatttcacaaaacaaatctaagaaagtaatacntgtaaattaaatgttttacaatccagacttccatt

SEQ ID NO: 41698 - DNA, 71 bp, chicken (Gallus Gallus)
  misc_feature (36): n=a or g
tctgttacataaacattactcttgctgacttttacnctggagaggtgttgcttgcactctccagatacttc

SEQ ID NO: 41699 - DNA, 71 bp, chicken (Gallus Gallus)
  misc_feature (36): n=a or g
tttttaattttttctcattgaaactgcagaagtggnaagaaatgaatgtaggttttcaaagtagagctctt

SEQ ID NO: 41700 - DNA, 71 bp, chicken (Gallus Gallus)
  misc_feature (36): n=a or g
cttcccatcaggcagtagggaactgaaactgagaangcatgtcaaagttgttgaatgttagtgttttcaga

SEQ ID NO: 41701 - DNA, 71 bp, chicken (Gallus Gallus)
  misc_feature (36): n=a or c
cagtgggagaaggaaggtaggagggagcatttctangttgttgaaagaagatgactctggtaatggctatt

SEQ ID NO: 41702 - DNA, 71 bp, chicken (Gallus Gallus)
  misc_feature (36): n=a or g
gaatacctctgctatcaattttccttagtgttagtntctgttgtatttcacaatcaagccctctctacgtc

SEQ ID NO: 41703 - DNA, 71 bp, chicken (Gallus Gallus)
  misc_feature (36): n=a or g
ggttgttctttctgcactcaggtggtatctgttccnagtatgggttgtctttctctttcccagcatctttc

SEQ ID NO: 41704 - DNA, 71 bp, chicken (Gallus Gallus)
  misc_feature (36): n=a or c
ctgaagcgtccgtaggtcttgtaggcagtatccagnagggcagaggaagttgttttcttcatagtaagtta

SEQ ID NO: 41705 - DNA, 71 bp, chicken (Gallus Gallus)
  misc_feature (36): n=c or t
aagaaaagcaaaaatacctcccatttttacctcagnccccttctcacctcctcccccaaggtccacttgct

SEQ ID NO: 41706 - DNA, 71 bp, chicken (Gallus Gallus)
  misc_feature (36): n=a or g
ctataattctaagaaatgttaggtggtgtttcctgnaaggcttgctgaatgcccaagtgttgggtagtagt

SEQ ID NO: 41707 - DNA, 71 bp, chicken (Gallus Gallus)
  misc_feature (36): n=a or c
acgatgttttgtcttgcagtaagttatttggaaaanaggagtgctggacaaaactgggcactggtcttgca

SEQ ID NO: 41708 - DNA, 71 bp, chicken (Gallus Gallus)
  misc_feature (36): n=c or t
taaatctgttccagatttcagtagtaagcaatcttnttttttaaaccacatgtaagtcataccagcattgg

SEQ ID NO: 41709 - DNA, 71 bp, chicken (Gallus Gallus)
  misc_feature (36): n=c or t
ctcttctaaagagcatgccaacaattgaggtagcangagggatcagcagtcctgtgcttaagctcacttcc

SEQ ID NO: 41710 - DNA, 71 bp, chicken (Gallus Gallus)
  misc_feature (36): n=a or g
accagaacaaaagactttctgctagtctttagttangagaaatcaccagcgttgcttttgattctgttttt

SEQ ID NO: 41711 - DNA, 71 bp, chicken (Gallus Gallus)
  misc_feature (36): n=c or t
atccagttcatggtacaacgtacctgtcttgcttcnctatgtctaaaatgcagtaccatcttctcacatac

SEQ ID NO: 41712 - DNA, 71 bp, chicken (Gallus Gallus)
  misc_feature (36): n=c or t
tgcagtgttcttcaaaagctattaaaatctttattnttcagtccagcaagttctgtatacgtggtccctgg

SEQ ID NO: 41713 - DNA, 71 bp, chicken (Gallus Gallus)
  misc_feature (36): n=a or c
tttaaaagtttattatagtcatcttttgtttcctgnaggcatgaataggatataggaaaagaaaaatataa

SEQ ID NO: 41714 - DNA, 71 bp, chicken (Gallus Gallus)
  misc_feature (36): n=a or g
cctccttaacttttctttcactgggattttaatctnctgcctctgttaagtgttaggttttcaccataaaa

SEQ ID NO: 41715 - DNA, 71 bp, chicken (Gallus Gallus)
  misc_feature (36): n=c or t
gcatttcaggtaaactgagctgtgaaatacatgctntagtggacattagaaaaatccagaactcaatcgta

SEQ ID NO: 41716 - DNA, 71 bp, chicken (Gallus Gallus)
  misc_feature (36): n=a or g
ggggttgttagcatggtatgagcacacacattgtgntcaaaatggacctatgattacagagcaggtaagta

SEQ ID NO: 41717 - DNA, 71 bp, chicken (Gallus Gallus)
  misc_feature (36): n=g or t
atgaaagttatgctgagataaatgctcttgagtgangtatggtgtttgaactaagagcataactgaccaat

SEQ ID NO: 41718 - DNA, 71 bp, chicken (Gallus Gallus)
  misc_feature (36): n=c or t
accctgtagaccagacccaggaggtggaggaagacntgggcttgctctatgacagcctggaagagtgcaac

SEQ ID NO: 41719 - DNA, 71 bp, chicken (Gallus Gallus)
  misc_feature (36): n=a or g
ttcaaagttgattgtgaggagttaccatgagaccanaggtcattatagaaggagcctaaagtcctctttgg

SEQ ID NO: 41720 - DNA, 71 bp, chicken (Gallus Gallus)
  misc_feature (36): n=c or t
gaatattctttgctcaggtaaaacctagatgaagcntctctgatgggtccagatgtgaggcgattctggtc

SEQ ID NO: 41721 - DNA, 71 bp, chicken (Gallus Gallus)
  misc_feature (36): n=a or g
gaaattttgttgccaaaataaagatttaggtattcnggtatttttcaccccttcttttcaaacagtcttaa

SEQ ID NO: 41722 - DNA, 71 bp, chicken (Gallus Gallus)
  misc_feature (36): n=a or g
ccaaagtaataaatataaaatggtaatttttctctntgagctgttcttgcttctcccccatgacttcactc

SEQ ID NO: 41723 - DNA, 71 bp, chicken (Gallus Gallus)
  misc_feature (36): n=a or g
caggctattctgcaatgcacttgaggtcagagtggnccaagtcttctcatgtggggaagacagtaaagaaa

SEQ ID NO: 41724 - DNA, 71 bp, chicken (Gallus Gallus)
  misc_feature (36): n=a or c
cacacggaggctaaaaccttctctttgttatgttcncctacagccagggttacctcaccttctatgtttct

SEQ ID NO: 41725 - DNA, 71 bp, chicken (Gallus Gallus)
  misc_feature (36): n=c or t
atattggtgctttcctttacctccatgccaatatgnttgtgtacagaggtaaagacatagtgcaagcaatg

SEQ ID NO: 41726 - DNA, 71 bp, chicken (Gallus Gallus)
  misc_feature (36): n=c or t
attattttcattctcatggatgaatcttgcaaagtncttcatttcctaagtcattcctaaggaattctctc

SEQ ID NO: 41727 - DNA, 71 bp, chicken (Gallus Gallus)
  misc_feature (36): n=a or g
gaaacaacagcatcgtgtgactttgtcagctccccntggaatgtggtaatgcagcctatgtgctgcattta

SEQ ID NO: 41728 - DNA, 71 bp, chicken (Gallus Gallus)
  misc_feature (36): n=a or c
aattttgtagagtttaataaaaatgcgaagaaaagncacagaaagctacatccattatttgctgttccgtg

SEQ ID NO: 41729 - DNA, 71 bp, chicken (Gallus Gallus)
  misc_feature (36): n=a or c
aaaaaaactgcaacatatcaaggcttagtaacacantgaatacaagagctttaacttgcaccacttccttg

SEQ ID NO: 41730 - DNA, 71 bp, chicken (Gallus Gallus)
  misc_feature (36): n=a or g
aagattatggtatatttttcctctataagcacttantgaatttaggctttgaagtttccctatgtttgtgc

SEQ ID NO: 41731 - DNA, 71 bp, chicken (Gallus Gallus)
  misc_feature (36): n=a or g
ttagcatagttattccataaggtaagttattacatngtgttattcactgcatcacccgggttaccaattgg

SEQ ID NO: 41732 - DNA, 71 bp, chicken (Gallus Gallus)
  misc_feature (36): n=c or t
gtttgtatttgtacagaagtaataacagatctaacngatacaggcttattccttgtctttttattaattta

SEQ ID NO: 41733 - DNA, 71 bp, chicken (Gallus Gallus)
  misc_feature (36): n=a or g
aggtgccatatgctaggagacagtcagtgatacccnttcatacgtgcatacatgtacatgcaatcacaaca

SEQ ID NO: 41734 - DNA, 71 bp, chicken (Gallus Gallus)
  misc_feature (36): n=a or c
gttatcttccgattgccttttcccaattagtactgnatattttaatactaaatgtctggaatatgctctat

SEQ ID NO: 41735 - DNA, 71 bp, chicken (Gallus Gallus)
  misc_feature (36): n=a or g
tctggagaaggcacaaattcagacataccaagcatnttttacacaccaaaaagcctcttgcttgctacatg

SEQ ID NO: 41736 - DNA, 71 bp, chicken (Gallus Gallus)
  misc_feature (36): n=a or g
tgactatcctccttatgaaagaccaatgtctgaacntaccgagataaacatccagcacccagtaagaaaga

SEQ ID NO: 41737 - DNA, 71 bp, chicken (Gallus Gallus)
  misc_feature (36): n=a or g
agactgatctgatatgaagcttaaacttttgcctcnccctaacctgacagagtatgcattttctctaaaag

SEQ ID NO: 41738 - DNA, 71 bp, chicken (Gallus Gallus)
  misc_feature (36): n=c or t
gatgaagagaaactataatgataaaattcacatccncaatgaaaaaaaagctatagccacgctggaaaaaa

SEQ ID NO: 41739 - DNA, 71 bp, chicken (Gallus Gallus)
  misc_feature (36): n=a or g
gacaagagcttcaaggatcgtaactcatacccagtntttcgtatcattataattatctcattgtatgtttc

SEQ ID NO: 41740 - DNA, 71 bp, chicken (Gallus Gallus)
  misc_feature (36): n=a or g
agactgtaacagcaaacaaataccaaataaaaatgntaagaatttttgagtcagttggctgaaattacaac

SEQ ID NO: 41741 - DNA, 71 bp, chicken (Gallus Gallus)
  misc_feature (36): n=c or t
taagaataagacagaaagaacaaaaccgtaaacaangacaaaaacaccagaaagataatcagtagataata

SEQ ID NO: 41742 - DNA, 71 bp, chicken (Gallus Gallus)
  misc_feature (36): n=g or t
tgagagacagatttacgtctttgcaacatttgatgnggggccagaaacagtctgacatattcttaatttgt

SEQ ID NO: 41743 - DNA, 71 bp, chicken (Gallus Gallus)
  misc_feature (36): n=a or c
cataaaattggcatgactgccctgaatcagctaacncaactggattactgcctgcagattgttgggagcag

SEQ ID NO: 41744 - DNA, 71 bp, chicken (Gallus Gallus)
  misc_feature (36): n=a or g
ggttactaatagctacaagatttatttcaaataccngtaccttagtccttctgctgtttgatcattcagtg

SEQ ID NO: 41745 - DNA, 71 bp, chicken (Gallus Gallus)
  misc_feature (36): n=c or t
tgctgttgtgtgttttcataggtttggggtgagaantttgcaggggattgggtgttttatctcctctctca

SEQ ID NO: 41746 - DNA, 71 bp, chicken (Gallus Gallus)
  misc_feature (36): n=a or g
tcatttcctatgacctactgtgccctagaagtctgnttttatacttgtaaatttaaacattttcagttgct

SEQ ID NO: 41747 - DNA, 71 bp, chicken (Gallus Gallus)
  misc_feature (36): n=a or g
tacaaccatctatttagccagcactttgagaaactngagtagtgttttggtgagttaatagagatctgtct

SEQ ID NO: 41748 - DNA, 71 bp, chicken (Gallus Gallus)
  misc_feature (36): n=c or t
tatagcaagaaagcactgtattcacaaagtatattncacaagggttttgtgcatccaggtacatttcaggt

SEQ ID NO: 41749 - DNA, 71 bp, chicken (Gallus Gallus)
  misc_feature (36): n=g or t
tcaaaatggtgggattgtatctagaggaagcattanctggaaataacaattgagtcctgctacccccacca

SEQ ID NO: 41750 - DNA, 71 bp, chicken (Gallus Gallus)
  misc_feature (36): n=g or t
cttataagtaatgatcacaataaggaaatgttcatncctacacaggccaagatcacttcctgttttcctag

SEQ ID NO: 41751 - DNA, 71 bp, chicken (Gallus Gallus)
  misc_feature (36): n=a or g
tttaaaactgcaattttaggggattggagagaatanaggaagctgaggcattctgtgatcatgcagtgata

SEQ ID NO: 41752 - DNA, 71 bp, chicken (Gallus Gallus)
  misc_feature (36): n=g or t
cattattcaatgtacgactaatgggtactgaaacancaaataaatgcaaagctatgacaaagtaaagcaag

SEQ ID NO: 41753 - DNA, 71 bp, chicken (Gallus Gallus)
  misc_feature (36): n=a or g
aactacacctcatttgtttttgctggcagtatgctntatttaaagctattacaattcaagaataactgaat

SEQ ID NO: 41754 - DNA, 71 bp, chicken (Gallus Gallus)
  misc_feature (36): n=a or c
tttataaattaattatagtagtactaatagctgttnttctgctttgaaagggatgttattacacctctggg

SEQ ID NO: 41755 - DNA, 71 bp, chicken (Gallus Gallus)
  misc_feature (36): n=c or t
gctgaagccaaaggcttgcccaagctcaagtatcanctactgccacgaacaaaaggatttgctgtcaccgt

SEQ ID NO: 41756 - DNA, 71 bp, chicken (Gallus Gallus)
  misc_feature (36): n=c or t
ctccaaatgccttcccttgttttgaagcttaccatnaacattttatgcaggtcctcttcaaaagcatcaat

SEQ ID NO: 41757 - DNA, 71 bp, chicken (Gallus Gallus)
  misc_feature (36): n=c or t
tactctgtctagcgatatgtcttctccaggacagantcctgaatcctgaaactcaaaacagcttcgaggag

SEQ ID NO: 41758 - DNA, 71 bp, chicken (Gallus Gallus)
  misc_feature (36): n=c or t
tgaatggtgcgttggtcagtcctgtgctggtctgcntggtcagtggtgatattcccctttttgattaaaga

SEQ ID NO: 41759 - DNA, 71 bp, chicken (Gallus Gallus)
  misc_feature (36): n=g or t
ttaccctgtgagtaaataacaattaccttggactanatccaaatattcattgtacaagatttttatcaccc

SEQ ID NO: 41760 - DNA, 71 bp, chicken (Gallus Gallus)
  misc_feature (36): n=c or t
atcaaggcatagcaatcatagttgtgctctagttanattataattaatacacaggtactcctggacatact

SEQ ID NO: 41761 - DNA, 71 bp, chicken (Gallus Gallus)
  misc_feature (36): n=c or t
ccagcagacacatttcagtcccattaaacagaaaangttaaaaccgtagttcacatgctgcttcattctgt

SEQ ID NO: 41762 - DNA, 71 bp, chicken (Gallus Gallus)
  misc_feature (36): n=c or t
tatctcctactatctcctaacttaccctcctgctcncctgaccccatgtgagtaacacatgcaccaaggtt

SEQ ID NO: 41763 - DNA, 71 bp, chicken (Gallus Gallus)
  misc_feature (36): n=c or t
cttgaaatgtgagtgaaaatgaccacagtccattgnacttcagataactgtagaagagctttgggtgtcag

SEQ ID NO: 41764 - DNA, 71 bp, chicken (Gallus Gallus)
  misc_feature (36): n=c or t
tgcttctaggactcagacagtattttgattttctgntttaaaacaattcagtgattttggactagatgttg

SEQ ID NO: 41765 - DNA, 71 bp, chicken (Gallus Gallus)
  misc_feature (36): n=a or g
gaataactcatgaatcaagcagggggacacgttttnatgagcagggacttgttcctatggtaatgtggaat

SEQ ID NO: 41766 - DNA, 71 bp, chicken (Gallus Gallus)
  misc_feature (36): n=c or t
aggagcttttgtctgaagatcacagaaaatttacangtggtagtggtggtgatcttacatgtgcaattaga

SEQ ID NO: 41767 - DNA, 71 bp, chicken (Gallus Gallus)
  misc_feature (36): n=c or t
gaggagtaacttctatctcagaaatactggatacanattattaggaaaagacgtggctaaatgtcagagat

SEQ ID NO: 41768 - DNA, 71 bp, chicken (Gallus Gallus)
  misc_feature (36): n=a or g
cttctagtttgcaaggatcagtgttgatgcataaanatagggagtaggcgaacgtgctcaaaaagtgtctg

SEQ ID NO: 41769 - DNA, 71 bp, chicken (Gallus Gallus)
  misc_feature (1): n=c
  misc_feature (2): n=g
  misc_feature (36): n=c or t
nnagggttggaggtaatactaatgcagaatctgtcntataccatttgcagtatctgtcctatggttttagg

SEQ ID NO: 41770 - DNA, 71 bp, chicken (Gallus Gallus)
  misc_feature (36): n=a or g
gaatggttggtattgattgaccagatgctcaagtcnaacatcgtcactgtgggaaatgctgaagagatcaa

SEQ ID NO: 41771 - DNA, 71 bp, chicken (Gallus Gallus)
  misc_feature (36): n=a or g
tgtaaagatagttttaagtgaaaacagggaaagtanttgagaggtttttgtagaagaatttggatttgaac

SEQ ID NO: 41772 - DNA, 71 bp, chicken (Gallus Gallus)
  misc_feature (36): n=c or t
agcattttaaatgggtaatttttgaatgcagttctncaaggagctttaattgtacaatagtgataatagct

SEQ ID NO: 41773 - DNA, 71 bp, chicken (Gallus Gallus)
  misc_feature (36): n=a or g
cctccaataattggcttgagacagcatttagttaantgatataggtttttgtcttgactgttcctctccgc

SEQ ID NO: 41774 - DNA, 71 bp, chicken (Gallus Gallus)
  misc_feature (36): n=c or t
gcatcaccagaagcatagcgattgaacatttgcagntagaacagtgcatttactttgatgttcacctagcc

SEQ ID NO: 41775 - DNA, 71 bp, chicken (Gallus Gallus)
  misc_feature (36): n=a or c
gtttttaaactgcactcagagaattctgtgggagtntgccaatagacagcaacccgtaatctatgtaaaaa

SEQ ID NO: 41776 - DNA, 71 bp, chicken (Gallus Gallus)
  misc_feature (36): n=a or g
ttgttggtggtttaaatcaaacagacttgaatttcngttttccttaaaatgctgagcggtaaactagaatg

SEQ ID NO: 41777 - DNA, 71 bp, chicken (Gallus Gallus)
  misc_feature (36): n=a or g
gataattaatctagtgataatttagaccaaatactngaagacatgacagagaaatcagcagatcatgaggc

SEQ ID NO: 41778 - DNA, 71 bp, chicken (Gallus Gallus)
  misc_feature (36): n=c or t
ctggtctgtgctttccggtaccacattacattgtcngatcagagaaagacaaattctttgctgtttgtttt

SEQ ID NO: 41779 - DNA, 71 bp, chicken (Gallus Gallus)
  misc_feature (36): n=c or t
gcccttcgagttcctggagcatctgtacaatacaanatccactacactgtaaaataattgaagctgaaagg

SEQ ID NO: 41780 - DNA, 71 bp, chicken (Gallus Gallus)
  misc_feature (36): n=a or g
aagcaccagtttagacttccttttctacatttactngtattgtatttcttcagagtaattttgaagtgaat

SEQ ID NO: 41781 - DNA, 71 bp, chicken (Gallus Gallus)
  misc_feature (36): n=c or t
tattgttcttgtttttattaaagaagatgctagaangcatgtaaacacttattaagaactattttatattt

SEQ ID NO: 41782 - DNA, 71 bp, chicken (Gallus Gallus)
  misc_feature (36): n=g or t
ttgaaaaggaatacataagaaagatcaaataccaancagaagagtggggttttctgttaatatttttgtta

SEQ ID NO: 41783 - DNA, 71 bp, chicken (Gallus Gallus)
  misc_feature (36): n=a or g
gattattattaaccactcatcatctgtcagtattcnaagaatattaagctgcagtatattccatcttcttg

SEQ ID NO: 41784 - DNA, 71 bp, chicken (Gallus Gallus)
  misc_feature (36): n=g or t
tagaaagtatttagttttgcttgctgaactactgtntgctctccttaactagtttcaaataaattcagctg

SEQ ID NO: 41785 - DNA, 71 bp, chicken (Gallus Gallus)
  misc_feature (36): n=a or g
tattactatctgatttataaatgtgaatgttacacntattcaggacaggattttagctgctatgaactttg

SEQ ID NO: 41786 - DNA, 71 bp, chicken (Gallus Gallus)
  misc_feature (36): n=c or t
ttgttacatcattgaaagcagcaagcctttattatnctgcagtgatgctcagagaatctgatcatccataa

SEQ ID NO: 41787 - DNA, 71 bp, chicken (Gallus Gallus)
  misc_feature (36): n=a or g
ttcagggacctctttagggctttgcttcattctgangcggtaaaacagaaaggaattgtttgctgtactaa

SEQ ID NO: 41788 - DNA, 71 bp, chicken (Gallus Gallus)
  misc_feature (36): n=a or g
tgccatgtttcattttgtaaatgacatctaactacngtggcccacctctcctaggctttcttgttagacag

SEQ ID NO: 41789 - DNA, 71 bp, chicken (Gallus Gallus)
  misc_feature (36): n=a or c
atgttttttcagtgaatgacagtgcagtttttgtcnctagaatagactcgaagatacctcagctttatgta

SEQ ID NO: 41790 - DNA, 71 bp, chicken (Gallus Gallus)
  misc_feature (36): n=g or t
tgctaaagagaaggctgaagtttaaagttaaaatanacaaactataaaatatggctaatggtaagcaagat

SEQ ID NO: 41791 - DNA, 71 bp, chicken (Gallus Gallus)
  misc_feature (36): n=a or g
cttggggggtttggccatactagcatctagtgattntcataaaagactgtttcttccagacaagttttata

SEQ ID NO: 41792 - DNA, 71 bp, chicken (Gallus Gallus)
  misc_feature (36): n=c or t
ttttcattatttacagaagtgattatgttgtgtagngtaggagctgaccaaataaataattgaacatggca

SEQ ID NO: 41793 - DNA, 71 bp, chicken (Gallus Gallus)
  misc_feature (36): n=a or g
acaggaagactgaagtgccaggtgcttgggcttacngcacatacctacagttgaaacttcatgtcagtgta

SEQ ID NO: 41794 - DNA, 71 bp, chicken (Gallus Gallus)
  misc_feature (36): n=a or g
gttgtacttttattttgggagcttggtaagaaaaangagacacttaaactagtgtccaaggtaaaatgata

SEQ ID NO: 41795 - DNA, 71 bp, chicken (Gallus Gallus)
  misc_feature (36): n=a or g
acagtaagaatgcgaagcacacagtatttataagangtacaaaacactctataattgctgaaagaagagga

SEQ ID NO: 41796 - DNA, 71 bp, chicken (Gallus Gallus)
  misc_feature (36): n=a or g
gcgagttatcagcttcctttgtatttcaggcttttnaagcatttctagttcttttgctgctgcaaagtaca

SEQ ID NO: 41797 - DNA, 71 bp, chicken (Gallus Gallus)
  misc_feature (36): n=c or t
tttctactgtttttaaactaacataatctggtacangttctatgaaaactggctctgaaagttcataaaat

SEQ ID NO: 41798 - DNA, 71 bp, chicken (Gallus Gallus)
  misc_feature (36): n=c or t
ctagtttaacttttggacagatgactaatgtggccngctgtgaatggcagtgcatcaggtgagagcatgta

SEQ ID NO: 41799 - DNA, 71 bp, chicken (Gallus Gallus)
  misc_feature (36): n=c or t
ataacagtacaggtcctgtgtgcatggaggtactgngcactggttcagcttagtttggcagtagtgcttga

SEQ ID NO: 41800 - DNA, 71 bp, chicken (Gallus Gallus)
  misc_feature (36): n=a or g
ccctccgagaggaacactgtgagccgagcaggcacntacacgttttggaaatgcttttcagactcacgacg

SEQ ID NO: 41801 - DNA, 71 bp, chicken (Gallus Gallus)
  misc_feature (36): n=a or c
atcccacatcttctggtttgactgccacactgaacnagaagtggagttggacctagtctgtactaagtgag

SEQ ID NO: 41802 - DNA, 71 bp, chicken (Gallus Gallus)
  misc_feature (36): n=c or t
tacctttactggacctttgcagatagcaaatgtganttacgggaaagtgaaagagctgcaaaataaatgtc

SEQ ID NO: 41803 - DNA, 71 bp, chicken (Gallus Gallus)
  misc_feature (36): n=a or g
acggtaacatttctggagacttgttctcacatgggnttaaatgatgataattgagaaagaattttatgctg

SEQ ID NO: 41804 - DNA, 71 bp, chicken (Gallus Gallus)
  misc_feature (36): n=a or g
cttaacagtgagttagtagaaagataatgatccttnggctccttacatacttaattggcatgtgtcttaag

SEQ ID NO: 41805 - DNA, 71 bp, chicken (Gallus Gallus)
  misc_feature (36): n=c or t
gtctattgctgttacgtgtgcagaaatctaaaacgnctgtactgtgagcaagctagcgcacactcaggtgg

SEQ ID NO: 41806 - DNA, 71 bp, chicken (Gallus Gallus)
  misc_feature (36): n=c or t
accagatgaatgcaagcagttacatccttgctcttngctgtatgaatttcctactagatataaattgattt

SEQ ID NO: 41807 - DNA, 71 bp, chicken (Gallus Gallus)
  misc_feature (36): n=g or t
acttcaatatttaaagcactgctgatgctgttttanttctacattggtgggtggaagcactcaagagtaaa

SEQ ID NO: 41808 - DNA, 71 bp, chicken (Gallus Gallus)
  misc_feature (36): n=c or t
attcgtacatctacagacaaatttgggttgtgtaangacacaaatctgcctgcagaaccaccatgagctca

SEQ ID NO: 41809 - DNA, 71 bp, chicken (Gallus Gallus)
  misc_feature (36): n=a or g
tcctaaactacttccagctcagagtaagatttaacnaaggtttacagaccataaccgactgtgtgaaattc

SEQ ID NO: 41810 - DNA, 71 bp, chicken (Gallus Gallus)
  misc_feature (36): n=a or g
tgttaacagatggtatggatgacatgtatgacagcntaacacctgaaagtaaatgcaaatgaaattagtct

SEQ ID NO: 41811 - DNA, 71 bp, chicken (Gallus Gallus)
  misc_feature (36): n=c or t
tgcaagattagcattttagcagattttataaattcnaaaaaatatgagatattagaggaatgaaagggatg

SEQ ID NO: 41812 - DNA, 71 bp, chicken (Gallus Gallus)
  misc_feature (36): n=c or t
tactgaatagtgtaatacttcatagactaagtccanttcatggaaaggtttagccctgctagaccttggtt

SEQ ID NO: 41813 - DNA, 71 bp, chicken (Gallus Gallus)
  misc_feature (36): n=c or t
atgagaattttcagtttggttgtttcactgcagagntcttggagctgaaattcatggctcgttgttactgg

SEQ ID NO: 41814 - DNA, 71 bp, chicken (Gallus Gallus)
  misc_feature (36): n=c or t
gccagaaagaattaactgtttcagaagtggatatcngtaacctaaaaccctgaaccttagctataaaactt

SEQ ID NO: 41815 - DNA, 71 bp, chicken (Gallus Gallus)
  misc_feature (36): n=c or t
tcttccaatgaagctagattctgcatgagctgctcncttgctgtggcaagtataaagggctccagctcaga

SEQ ID NO: 41816 - DNA, 71 bp, chicken (Gallus Gallus)
  misc_feature (36): n=a or g
ttttgcaggagtagttccactgactctcttcttccntatttaataatccatgattttaactttgattctgc

SEQ ID NO: 41817 - DNA, 71 bp, chicken (Gallus Gallus)
  misc_feature (36): n=c or t
gtgttatctagtacaacaaattacaattgaaataanagacagtggcttaaattgagctttaatacacatca

SEQ ID NO: 41818 - DNA, 71 bp, chicken (Gallus Gallus)
  misc_feature (36): n=c or t
cattaacactaatacaacagggaacaaaagacatgnaaaatagccttgttgcatggtcttctatatgcaat

SEQ ID NO: 41819 - DNA, 71 bp, chicken (Gallus Gallus)
  misc_feature (36): n=a or g
aaccttagatgctggggttttttttaatccttattnttgttgttattataatttcctcctattattttttc

SEQ ID NO: 41820 - DNA, 71 bp, chicken (Gallus Gallus)
  misc_feature (36): n=c or t
catacctaataaaagtgctttactttaacagggtanagatatgagactgagctgtgtgaagacagtaattc

SEQ ID NO: 41821 - DNA, 71 bp, chicken (Gallus Gallus)
  misc_feature (36): n=c or t
gcaagttgaaagtttctaaccaataacaagctgaanacccacaaagataccttcagaagagaaaggacaga

SEQ ID NO: 41822 - DNA, 71 bp, chicken (Gallus Gallus)
  misc_feature (36): n=a or c
taacattttcaaaaaacgctgtgtaatccaactccntttcatgtgttggaatttttgtctcctaaagttct

SEQ ID NO: 41823 - DNA, 71 bp, chicken (Gallus Gallus)
  misc_feature (36): n=g or t
gtaaaattatgagaacttcctggaggatagcagctncttccgtcaggggaacataaatcttttaggagtac

SEQ ID NO: 41824 - DNA, 71 bp, chicken (Gallus Gallus)
  misc_feature (36): n=g or t
aagttctagagagagaaggcatttccttgaagagangaaacaactggtacaagctgtcccagtgcagagaa

SEQ ID NO: 41825 - DNA, 71 bp, chicken (Gallus Gallus)
  misc_feature (36): n=c or t
tgagactgaaggagacctcaggtacattaacagttnacatctgtgtattggattcctgttaagatatttaa

SEQ ID NO: 41826 - DNA, 71 bp, chicken (Gallus Gallus)
  misc_feature (36): n=g or t
gaaagttttcaggagcctccagttgaagaatactcngttctggaagaactcctggcatgcgagccagagag

SEQ ID NO: 41827 - DNA, 71 bp, chicken (Gallus Gallus)
  misc_feature (36): n=c or t
agcactgcatcacacttcgaaaatggcctgaaatcngaaatggagcagcgtgttaagtaccagcactcttc

SEQ ID NO: 41828 - DNA, 71 bp, chicken (Gallus Gallus)
  misc_feature (36): n=c or t
gtatggatagaagtgggttgcaataagatggacttngcagtgagcttgccttttgtgtctcttcccttgaa

SEQ ID NO: 41829 - DNA, 71 bp, chicken (Gallus Gallus)
  misc_feature (36): n=c or t
tgaactcacagttacttagtaatcaaaacatccctnacttcaagaacactttctttactctgtatgtagac

SEQ ID NO: 41830 - DNA, 71 bp, chicken (Gallus Gallus)
  misc_feature (36): n=c or t
gcaatacaacttaagaactgtctagacttttctgtntaaaataaccttcgacaactgtgcaaagcatcctg

SEQ ID NO: 41831 - DNA, 71 bp, chicken (Gallus Gallus)
  misc_feature (36): n=c or t
agaagatggaggggcagtaattctttctgacttttntgttgatcagttgggtttttgttagttttttttac

SEQ ID NO: 41832 - DNA, 71 bp, chicken (Gallus Gallus)
  misc_feature (36): n=a or g
aaaaaactctctacagctcacagatcaccttaaatnaatcatatccaggcccaaattcataagtctataga

SEQ ID NO: 41833 - DNA, 71 bp, chicken (Gallus Gallus)
  misc_feature (36): n=a or g
acagtgcagagatgctgagacatgatggacagtctnctacgttgcttgcctcctgtattagctgtaagcct

SEQ ID NO: 41834 - DNA, 71 bp, chicken (Gallus Gallus)
  misc_feature (36): n=g or t
ggcaacaatgtggatggctgcacgagagaagagagncacaagactacagacatgctcatatgtatcctcag

SEQ ID NO: 41835 - DNA, 71 bp, chicken (Gallus Gallus)
  misc_feature (36): n=g or t
tttttttttaattaatctggaacctgaggatatttntttaaccagaggcagaattaaagattaaggagaga

SEQ ID NO: 41836 - DNA, 71 bp, chicken (Gallus Gallus)
  misc_feature (36): n=a or g
tgtttctaagtctctcaggaaggaaccactcggganctaagagcaggtgcaaacaaacacaagagtggaaa

SEQ ID NO: 41837 - DNA, 71 bp, chicken (Gallus Gallus)
  misc_feature (36): n=a or g
ccagtttttatggaattacttgcaaaaatggcaacncactctggaatacgggaggaaagatgaacaagagt

SEQ ID NO: 41838 - DNA, 71 bp, chicken (Gallus Gallus)
  misc_feature (36): n=a or g
tataatgggatcctatggtggtgactgtaatcactnaactcttgcaacgtaaatgtttaaagctagacgaa

SEQ ID NO: 41839 - DNA, 71 bp, chicken (Gallus Gallus)
  misc_feature (36): n=c or t
agtatttaggatgtggtgaatgcacagcacaagaangtgataagcaacttctcaaagcaaagctgcacttt

SEQ ID NO: 41840 - DNA, 71 bp, chicken (Gallus Gallus)
  misc_feature (36): n=a or g
gtatctgcatgcacatgtttatgtgtgaattctccngggagaaggcatttgcaggtctcactcctgaatta

SEQ ID NO: 41841 - DNA, 71 bp, chicken (Gallus Gallus)
  misc_feature (36): n=c or t
gaagacttaaagtagggcataaaacctatgaaatcnactctgtctttctgaagaacttaaaattctcagtg

SEQ ID NO: 41842 - DNA, 71 bp, chicken (Gallus Gallus)
  misc_feature (36): n=c or t
ctccctcattagttatgagatgctgatgtggttcanggggatactctggcagtcctagtttatcagcacag

SEQ ID NO: 41843 - DNA, 71 bp, chicken (Gallus Gallus)
  misc_feature (36): n=a or g
atttgtaaaagtagcactgttagatttaaaactttnaaaaagcaagatctgtgaatgtactccattatatt

SEQ ID NO: 41844 - DNA, 71 bp, chicken (Gallus Gallus)
  misc_feature (36): n=c or t
aattgtttgaggcataggaaattataaattcatttncttcctgcagcagtgcagtgcgatataacttctta

SEQ ID NO: 41845 - DNA, 71 bp, chicken (Gallus Gallus)
  misc_feature (36): n=a or g
tgtgcaagtgaaagtgtcctttctgccgcttcagantgtcagagatggacacttattttccatgcttctct

SEQ ID NO: 41846 - DNA, 71 bp, chicken (Gallus Gallus)
  misc_feature (36): n=a or g
agtgaaaacattacccaaagtatttggttggtgagnaatttttaatttggaatcctacgtcccattgttgc

SEQ ID NO: 41847 - DNA, 71 bp, chicken (Gallus Gallus)
  misc_feature (36): n=a or g
tattttggatatcatttccttcttgtcaacctgctnaagaaataatctaggctttgtttaggtgcactgct

SEQ ID NO: 41848 - DNA, 71 bp, chicken (Gallus Gallus)
  misc_feature (36): n=a or g
ctgtgtagatgctgcttttaaaatatggtacagaanctctgagtagatagcgttgactttcttccttccag

SEQ ID NO: 41849 - DNA, 71 bp, chicken (Gallus Gallus)
  misc_feature (36): n=a or g
atcaaggccagtctgaggtaaagaaactaagagcantcgaagctcatcttctatgagataatcctgtgaga

SEQ ID NO: 41850 - DNA, 71 bp, chicken (Gallus Gallus)
  misc_feature (36): n=c or t
aaaaggagagggggccaaaataagagagggtgaacnaaaagtagtgtagtgcaactcctttgcttcttgat

SEQ ID NO: 41851 - DNA, 71 bp, chicken (Gallus Gallus)
  misc_feature (36): n=a or g
tggaaattcttcgcttaggtcaggttaaggtaaaanccgatgtgttcctacttataaagttcacgttagag

SEQ ID NO: 41852 - DNA, 71 bp, chicken (Gallus Gallus)
  misc_feature (36): n=c or t
ggtggtggctgagttcttacctgaggacagaacttncttaaatttatttctggtacactgtgattttatgt

SEQ ID NO: 41853 - DNA, 71 bp, chicken (Gallus Gallus)
  misc_feature (36): n=a or g
attatactacatcagataagtagttttcagttgtcntctagtctgtgcttcttgctggaaccagaaggaga

SEQ ID NO: 41854 - DNA, 71 bp, chicken (Gallus Gallus)
  misc_feature (36): n=g or t
ttaactctttacttgaaaagctgtataacatgaganaaacagatgtgattttatctctctttttgaaaatt

SEQ ID NO: 41855 - DNA, 71 bp, chicken (Gallus Gallus)
  misc_feature (36): n=g or t
agtctgagctaaactcaccaaacccactaggtaaangaaaaggtgggagatgcatccagctttgtgtgtga

SEQ ID NO: 41856 - DNA, 71 bp, chicken (Gallus Gallus)
  misc_feature (36): n=a or g
ttagcaggatttttatagactcttcaaaagcgctgnccagaaggatttgagacacaaagacaaatggaaaa

SEQ ID NO: 41857 - DNA, 71 bp, chicken (Gallus Gallus)
  misc_feature (36): n=a or g
atgaaggtaatcactggaacaacccgtgctgtgcantttgtagccctcatctaagtgaaacacagaatgta

SEQ ID NO: 41858 - DNA, 71 bp, chicken (Gallus Gallus)
  misc_feature (36): n=a or g
ttttagtgagcaatctgctgatctgtttcctttggnagaatgtgtaccctttttctgtgtgtctgaagttg

SEQ ID NO: 41859 - DNA, 71 bp, chicken (Gallus Gallus)
  misc_feature (36): n=a or g
agaaccatctcttccagatgttttcaccattttttncctagtttcaaatatttaattgctctgtgcaacaa

SEQ ID NO: 41860 - DNA, 71 bp, chicken (Gallus Gallus)
  misc_feature (36): n=c or t
atagcaggtgaatttcacctgtctgcagtaggtaantcaggagctaggtactaattgagtaccacttgaac

SEQ ID NO: 41861 - DNA, 71 bp, chicken (Gallus Gallus)
  misc_feature (36): n=c or t
ttctaaagtttaggcagttgtttccttagcaacaanttggttgtctttcagtttctacccgtttagtatga

SEQ ID NO: 41862 - DNA, 71 bp, chicken (Gallus Gallus)
  misc_feature (36): n=a or g
ctggaggaagtgctgactgtctgtgtgcaactgagncttgctcaaataaaggagtagtggccaccgcacaa

SEQ ID NO: 41863 - DNA, 71 bp, chicken (Gallus Gallus)
  misc_feature (36): n=a or g
cagaagagaacacaatttggtccttacgttggtcanctgtctacaaaattgacctgctacgatgagagtag

SEQ ID NO: 41864 - DNA, 71 bp, chicken (Gallus Gallus)
  misc_feature (36): n=a or c
cagtgtttgtgtttggatgaatagtaaagcaatgtnaaaaatcaacacataagagtatatactaatctgtg

SEQ ID NO: 41865 - DNA, 71 bp, chicken (Gallus Gallus)
  misc_feature (36): n=c or t
ctccttttagcttacattttagcacattagaacatnaagcgttctttatccgttgtatgtttgttactgtc

SEQ ID NO: 41866 - DNA, 71 bp, chicken (Gallus Gallus)
  misc_feature (36): n=c or t
cacaggcaatacagctgaactaggcccaagtaaacngcccttctcgttcccgtgcagagcttcctaccaca

SEQ ID NO: 41867 - DNA, 71 bp, chicken (Gallus Gallus)
  misc_feature (36): n=a or c
tagctgcagaagctcaggccctgacacacgacatgnatggtctttgtggtgtactgaaggagataaagata

SEQ ID NO: 41868 - DNA, 71 bp, chicken (Gallus Gallus)
  misc_feature (36): n=c or t
aagggtactgacatctgtccatagcagtactcacanctatagagctaaattaaaattaacccagggcttaa

SEQ ID NO: 41869 - DNA, 71 bp, chicken (Gallus Gallus)
  misc_feature (36): n=a or g
tctcagagatggcaaactcttcctttcacatgaagnggcacttctggagcatacctaatgcactccagctg

SEQ ID NO: 41870 - DNA, 71 bp, chicken (Gallus Gallus)
  misc_feature (36): n=c or t
aaaatagattttccccataaagtagaaagtgttacnaacataaatgcaatccttcttccaaagactcagtt

SEQ ID NO: 41871 - DNA, 71 bp, chicken (Gallus Gallus)
  misc_feature (36): n=c or t
gtagctcctgaaagcatcctgcgtagttatgtgggnggacagttccttgaaagaataatacccagctgaat

SEQ ID NO: 41872 - DNA, 71 bp, chicken (Gallus Gallus)
  misc_feature (36): n=c or t
actgctgtatgaattcacttttcctcttacacagancatattaatcataactaagacctttttttttgctt

SEQ ID NO: 41873 - DNA, 71 bp, chicken (Gallus Gallus)
  misc_feature (36): n=a or g
gaatatgggacacctgagaggtatttttgttatgcnttaaagggccaggttgaagtttagggggaaaaatg

SEQ ID NO: 41874 - DNA, 71 bp, chicken (Gallus Gallus)
  misc_feature (36): n=c or t
ggaatctttcagagcaatgaatttctgagtgagggntgaagtgcttttaatctgatctgtaggtcgggagt

SEQ ID NO: 41875 - DNA, 71 bp, chicken (Gallus Gallus)
  misc_feature (36): n=a or g
taatattttttaaaagaataatgtccctgcatgggnttttatcaatacgctggcagaactggaagatatat

SEQ ID NO: 41876 - DNA, 71 bp, chicken (Gallus Gallus)
  misc_feature (36): n=a or g
gaatgtgttcaaaagacattcatttgggtacttgcngatgaaggaaataaatgccagattcacagaagctg

SEQ ID NO: 41877 - DNA, 71 bp, chicken (Gallus Gallus)
  misc_feature (36): n=c or t
cagagcatctcctgcataaactttccaacctctatntcatgccactgtgcctaaagtacaacattttctgt

SEQ ID NO: 41878 - DNA, 71 bp, chicken (Gallus Gallus)
  misc_feature (36): n=c or t
tgctaactaaagaaaggaatgtacagacaactatgnttaccgacaaactatgaagtgagcaggatgtccag

SEQ ID NO: 41879 - DNA, 71 bp, chicken (Gallus Gallus)
  misc_feature (36): n=g or t
tgatagagagtcccctctgttctgaaagtcttctgntgcttcactaggacaaaggcttctcctggggcaat

SEQ ID NO: 41880 - DNA, 71 bp, chicken (Gallus Gallus)
  misc_feature (36): n=a or g
agggcaagcagtggtggagattcttacatcattttntacagagtaaatcagctctgagctgaaattcttct

SEQ ID NO: 41881 - DNA, 71 bp, chicken (Gallus Gallus)
  misc_feature (36): n=a or g
ggactagtactcactcaaatgcaatgtatgtcagangagttgcagctgaaaatatagccgatatcccacag

SEQ ID NO: 41882 - DNA, 71 bp, chicken (Gallus Gallus)
  misc_feature (36): n=c or t
tcctttgtctctcagcacacaccacacctgtgctcngtataggtaaaagctaaagtggacaaagaaaacac

SEQ ID NO: 41883 - DNA, 71 bp, chicken (Gallus Gallus)
  misc_feature (36): n=a or g
ttttgctgatggtaacactgagtcttctgttccaancgcagtgtcataggtggtttctctttttttttttt

SEQ ID NO: 41884 - DNA, 71 bp, chicken (Gallus Gallus)
  misc_feature (36): n=a or c
tgcctaatgcatttttggagtgtgataaaaaagacnacggaccacagtaatggctccctactcttctttct

SEQ ID NO: 41885 - DNA, 71 bp, chicken (Gallus Gallus)
  misc_feature (36): n=c or t
acaatttcctgagtaattgcttcattatcgccaaantgttttttcatctgaaaaaaagttgaaaaaaacac

SEQ ID NO: 41886 - DNA, 71 bp, chicken (Gallus Gallus)
  misc_feature (36): n=a or g
ctgcggatgaaccactggtggcaatactccaaagcnataaacaccttaactcagatctccaatctgatagt

SEQ ID NO: 41887 - DNA, 71 bp, chicken (Gallus Gallus)
  misc_feature (36): n=a or g
tgggcagggacgcactttacctagagatatgtcacngcaaggcatggactgcagtgttgggcaaggttcaa

SEQ ID NO: 41888 - DNA, 71 bp, chicken (Gallus Gallus)
  misc_feature (36): n=c or t
gtttataactcaagacgaagatattctttctttcangattattttgggtacaggaggagattactttgtat

SEQ ID NO: 41889 - DNA, 71 bp, chicken (Gallus Gallus)
  misc_feature (36): n=c or t
agtctgaatattggactacacttaattatactgatntctgctgttctattacagccttccctaataaaatc

SEQ ID NO: 41890 - DNA, 71 bp, chicken (Gallus Gallus)
  misc_feature (36): n=a or g
ccttcttagatttgcaaaatggattaaaagagcacnttttagttcaaataactccttgaaaaaactggagc

SEQ ID NO: 41891 - DNA, 71 bp, chicken (Gallus Gallus)
  misc_feature (36): n=a or g
aaaaaaaagtcattttaatcctccttgatgtggggngaacacccttatattgaaacattatttaagagagt

SEQ ID NO: 41892 - DNA, 71 bp, chicken (Gallus Gallus)
  misc_feature (36): n=c or t
tatgagttaatatgaattaatatgcatatcttcatntgtatctaatttgactagatgatgcaaatcagagg

SEQ ID NO: 41893 - DNA, 71 bp, chicken (Gallus Gallus)
  misc_feature (36): n=a or g
taatttatttggaaccattagtgggtgggtggtgcntgcactgtgggctgtggtttcattgataggctcag

SEQ ID NO: 41894 - DNA, 71 bp, chicken (Gallus Gallus)
  misc_feature (36): n=a or g
aactgttgtcattagctctggtgccatgctataagncttctttcacaagtcttgaaataatgcagttgtag

SEQ ID NO: 41895 - DNA, 71 bp, chicken (Gallus Gallus)
  misc_feature (36): n=c or t
attcccccccagtaattaagcccacagggacagctngtagcttctaatgcatataagattcagcaaccaca

SEQ ID NO: 41896 - DNA, 71 bp, chicken (Gallus Gallus)
  misc_feature (36): n=a or g
tgcatctctacaatttcaggatcaatagaagctgangattgaaagaaagtatattataagaagtgtttaag

SEQ ID NO: 41897 - DNA, 71 bp, chicken (Gallus Gallus)
  misc_feature (36): n=c or t
tttttacagtcatagacatactctgctttttttctnatgctgaacaccagtctgaggtttatgtatgctat

SEQ ID NO: 41898 - DNA, 71 bp, chicken (Gallus Gallus)
  misc_feature (36): n=c or t
acacatcctttcctcagcatggtagcagtaaagaanaagtctcttcagcagccttcctcccagcaaccact

SEQ ID NO: 41899 - DNA, 71 bp, chicken (Gallus Gallus)
  misc_feature (36): n=g or t
tagttcctttttattatattagtaaaattatgactntctacagtaaaatcggattggataactcccacaca

SEQ ID NO: 41900 - DNA, 71 bp, chicken (Gallus Gallus)
  misc_feature (36): n=c or t
agatgattacaactaattcatgagtaaaacttatcntccatttcatcgccactgcctctctctatttaagt

SEQ ID NO: 41901 - DNA, 71 bp, chicken (Gallus Gallus)
  misc_feature (36): n=a or c
ctaggaagaaggcaattcctacgtccaaatctcctnaactagtagaagcttacagcagctttatataccac

SEQ ID NO: 41902 - DNA, 71 bp, chicken (Gallus Gallus)
  misc_feature (36): n=g or t
acaaaatgtgtttaccttcctagagagcttttggtnagaggtattccacttttggaaactcagccaaatta

SEQ ID NO: 41903 - DNA, 71 bp, chicken (Gallus Gallus)
  misc_feature (36): n=c or t
aaagttttcagattttcgtagaattatatgcctacntctttagtattaaactttcctccaacctgaaataa

SEQ ID NO: 41904 - DNA, 71 bp, chicken (Gallus Gallus)
  misc_feature (36): n=a or g
cttgcaaagagtcccttgtggaaacaaaacaaagcnaaacacgttcacacagcctggtaaagctctcctta

SEQ ID NO: 41905 - DNA, 71 bp, chicken (Gallus Gallus)
  misc_feature (36): n=a or g
actgttaatgaccaagaggcttgggacatagaatcnggatgcatgcaggatattttgaccctgaggtccca

SEQ ID NO: 41906 - DNA, 71 bp, chicken (Gallus Gallus)
  misc_feature (36): n=c or t
aagtccagaagtgcaggaacaggttcttgctcaagnctcatcaaggaacaaactactttaatgagcgccca

SEQ ID NO: 41907 - DNA, 71 bp, chicken (Gallus Gallus)
  misc_feature (36): n=g or t
ttgacataaattatctatgaccacagtaataatacncatatattcacaccaaaaaggtcgctgcaatgcat

SEQ ID NO: 41908 - DNA, 71 bp, chicken (Gallus Gallus)
  misc_feature (36): n=a or c
ttgtcctctctgttggacccatggttggagacttanaatatatgggtgcttgcttgagagtttgggtaggt

SEQ ID NO: 41909 - DNA, 71 bp, chicken (Gallus Gallus)
  misc_feature (36): n=a or g
aaaaagataaacagggactacaagtgtgtcttctantgctataggaacacagctgatattgcagacagctg

SEQ ID NO: 41910 - DNA, 71 bp, chicken (Gallus Gallus)
  misc_feature (36): n=c or t
tttcttttagaaacaaggtaattaccattccagatncaacctgaggttctccaatttaacgttcaatacca

SEQ ID NO: 41911 - DNA, 71 bp, chicken (Gallus Gallus)
  misc_feature (36): n=c or t
acaggaggttgtgaaacaaagactatgtgcagtaanatgtaagttgcaatacctcttatttacttccatgg

SEQ ID NO: 41912 - DNA, 71 bp, chicken (Gallus Gallus)
  misc_feature (36): n=a or g
gcatgcttttgtacatgttgagtttttggaacctcnatagtaacaaatgaaaactttacttttccaaagat

SEQ ID NO: 41913 - DNA, 71 bp, chicken (Gallus Gallus)
  misc_feature (36): n=g or t
gattacatagaagacatgatattagttctcaaaacnggagctgacgtttaccagttttgatcacgtgagga

SEQ ID NO: 41914 - DNA, 71 bp, chicken (Gallus Gallus)
  misc_feature (36): n=a or g
gaattaaattgaactgtgtgtgtaggacagtaaccnagacacaaacttcatgttttcctccttgctgtctg

SEQ ID NO: 41915 - DNA, 71 bp, chicken (Gallus Gallus)
  misc_feature (36): n=g or t
taattacagagggctattacatagcagcaaaggaanaaatgaaattaagatatggaagagaaagtaatggg

SEQ ID NO: 41916 - DNA, 71 bp, chicken (Gallus Gallus)
  misc_feature (36): n=a or g
ctcagcgagtgcagcagttctcaactgttctggtgnaaatagtgcacatctttattacgcttcaacttcgt

SEQ ID NO: 41917 - DNA, 71 bp, chicken (Gallus Gallus)
  misc_feature (36): n=c or t
ctagaagtactttcttaatgaatatttggaagagcngatcttttatgggatagcatttttcatagtcagtg

SEQ ID NO: 41918 - DNA, 71 bp, chicken (Gallus Gallus)
  misc_feature (36): n=g or t
agtctatgtaattttcagtcactacagaaagtgtgncagtcccatagaagatgatgtatatctcccttatt

SEQ ID NO: 41919 - DNA, 71 bp, chicken (Gallus Gallus)
  misc_feature (36): n=a or c
ctcaagtatcttgaaaccaagatacttctgaacccngaatgaaccaggagggttagttccagtcttgagaa

SEQ ID NO: 41920 - DNA, 71 bp, chicken (Gallus Gallus)
  misc_feature (36): n=g or t
cagtcagtctccagctttggtccctctgtaaatttncctgatgatttcctgacaaggctggagacaagttt

SEQ ID NO: 41921 - DNA, 71 bp, chicken (Gallus Gallus)
  misc_feature (36): n=a or g
cttcaaatttcatgcctctaaatcagaatgcttaanatgaaactacctctcttagtcttggatctcattag

SEQ ID NO: 41922 - DNA, 71 bp, chicken (Gallus Gallus)
  misc_feature (36): n=c or t
gtatccatcagagctggctgcaagctaacatggtanggtatttggttactgtacttgcaggagagatggct

SEQ ID NO: 41923 - DNA, 71 bp, chicken (Gallus Gallus)
  misc_feature (36): n=c or t
tgagcaacggtgcacttacttcctcttctctgtacngtaatttctccctttcttctgactccacttatttg

SEQ ID NO: 41924 - DNA, 71 bp, chicken (Gallus Gallus)
  misc_feature (36): n=a or g
tttggtctggttagaattgaactttaccctcctttnggatgcttcaagttcttgttgggcgattagtggag

SEQ ID NO: 41925 - DNA, 71 bp, chicken (Gallus Gallus)
  misc_feature (36): n=a or g
acccataacagaaatctcaacaatgataagcatatnaggcgtggacaaagctataaagtgttacttatagt

SEQ ID NO: 41926 - DNA, 71 bp, chicken (Gallus Gallus)
  misc_feature (36): n=c or t
cagtacccctcagttctggctttcaacaccgttgtngttccagtaatgtctctctctttagctgtagctgc

SEQ ID NO: 41927 - DNA, 71 bp, chicken (Gallus Gallus)
  misc_feature (36): n=a or g
gaattcagcactgctacaccagtgtaaacctggcanaagagataagactgagctactgtacacatcccttt

SEQ ID NO: 41928 - DNA, 71 bp, chicken (Gallus Gallus)
  misc_feature (36): n=a or g
catattgctgttgacactgaagcatttcatggttgntcagtatttccagtctttacctaacagctcaatgt

SEQ ID NO: 41929 - DNA, 71 bp, chicken (Gallus Gallus)
  misc_feature (36): n=c or t
atttcctccttgattctgtgacaaacttggaatgcngtggcagctgatgaaggggaactatctcagcctta

SEQ ID NO: 41930 - DNA, 71 bp, chicken (Gallus Gallus)
  misc_feature (36): n=c or t
ataagcatacaggtgatacagatgcaattgaaaaantatttagaagtagttgttgttaattcactgccacc

SEQ ID NO: 41931 - DNA, 71 bp, chicken (Gallus Gallus)
  misc_feature (36): n=c or t
tgactatcatccaaaagactgtaaagagaattttantttttcaacactagaaccttagctgcagtgctgca

SEQ ID NO: 41932 - DNA, 71 bp, chicken (Gallus Gallus)
  misc_feature (36): n=c or t
taatcataactgagggatagagccttgtcctgtgtnattccttacctgtgtattaggctttatttatatga

SEQ ID NO: 41933 - DNA, 71 bp, chicken (Gallus Gallus)
  misc_feature (36): n=c or t
agagtgccagtggtgtaggactagaaaaccattcancagtcctactaagggatgacaattaccaggttctc

SEQ ID NO: 41934 - DNA, 71 bp, chicken (Gallus Gallus)
  misc_feature (36): n=a or g
atatcttctatgcaacaccttcactgagatatccantacaacataaaaggtggttatttgcagttatgggt

SEQ ID NO: 41935 - DNA, 71 bp, chicken (Gallus Gallus)
  misc_feature (36): n=a or g
ccaagagaatctcttgttagagtagtacactttatntgacctgattttgtactttattctttcagcgtgtt

SEQ ID NO: 41936 - DNA, 71 bp, chicken (Gallus Gallus)
  misc_feature (36): n=c or t
aggagatcaatatcagtattttcaggtgaggctgcngatttctcttccttgcaaccacagaccaccatgtc

SEQ ID NO: 41937 - DNA, 71 bp, chicken (Gallus Gallus)
  misc_feature (36): n=c or t
agggcatgtgacacgagacctgtaacatactatagnaatgtgttgagactccgtaagtacttcactgagtg

SEQ ID NO: 41938 - DNA, 71 bp, chicken (Gallus Gallus)
  misc_feature (36): n=c or t
ggacaactgaaacatgaaactgaaccgcaaactggncatttcctgagctacttgcggtgatttgcttctgc

SEQ ID NO: 41939 - DNA, 71 bp, chicken (Gallus Gallus)
  misc_feature (36): n=c or t
tttaaagcagcagcacatacctctgagtagagtctngcctggttttagcacaggcatgaacggaggcaagg

SEQ ID NO: 41940 - DNA, 71 bp, chicken (Gallus Gallus)
  misc_feature (36): n=a or g
atctcacagtgaggttacccagcacggaagcaggtnttgtcttgagcaacagagattgggtgcaaatccag

SEQ ID NO: 41941 - DNA, 71 bp, chicken (Gallus Gallus)
  misc_feature (36): n=a or g
aaaaaggccaacaagcagattaagtctatccagttngatgtttaaactcaacacataatgtcagagttggt

SEQ ID NO: 41942 - DNA, 71 bp, chicken (Gallus Gallus)
  misc_feature (36): n=a or g
cacgtgcaggagacattgtatgcttgtgaattgcantgccctctcgggctgctgaaagcaagcagctcaat

SEQ ID NO: 41943 - DNA, 71 bp, chicken (Gallus Gallus)
  misc_feature (36): n=c or t
atcaaaatcccctccttatcctctcctcagatgccngacatgctgttgaaatatctgaattcaaagaccct

SEQ ID NO: 41944 - DNA, 71 bp, chicken (Gallus Gallus)
  misc_feature (36): n=c or t
actcagcatgttcagcagcatggggctctttcaggntctcagagcatgtatgcagttaagctaattttaag

SEQ ID NO: 41945 - DNA, 71 bp, chicken (Gallus Gallus)
  misc_feature (36): n=a or g
tttatgttgactgtgtggtgtatgcatgcaatcctnaggccttccagcccaaataggccactagcttccct

SEQ ID NO: 41946 - DNA, 71 bp, chicken (Gallus Gallus)
  misc_feature (36): n=a or c
caagatcaaacgctgggaggaaatatggttgtaatntcaataaacacctgtctggtattactctacctgtt

SEQ ID NO: 41947 - DNA, 71 bp, chicken (Gallus Gallus)
  misc_feature (36): n=a or g
gtttgaatatgcccagtgaacataaggagttttgcnggccatccctggaactttctcagaaaagcaatgct

SEQ ID NO: 41948 - DNA, 71 bp, chicken (Gallus Gallus)
  misc_feature (36): n=g or t
ctagaggcttccccatcacttgttttccacgagggntatatagttcctaggttcaatagaatttgatggag

SEQ ID NO: 41949 - DNA, 71 bp, chicken (Gallus Gallus)
  misc_feature (36): n=a or g
acagaaaggtatcaagaggtttcattagaatacaangagaagacattttgccatggaaaagaggagttgat

SEQ ID NO: 41950 - DNA, 71 bp, chicken (Gallus Gallus)
  misc_feature (36): n=a or c
atcagcttggaacaccacaagacacacatgagttgnggcaacagctgtgagtatctcacatgaaaatattt

SEQ ID NO: 41951 - DNA, 71 bp, chicken (Gallus Gallus)
  misc_feature (36): n=a or c
ctgggaggatacctacatggaataaaccctcctggngtacatacttctgcctgtgttcagcagatggggtg

SEQ ID NO: 41952 - DNA, 71 bp, chicken (Gallus Gallus)
  misc_feature (36): n=c or t
tggggaaagtctggtatgtcatttgttatgcttaantgtccccacactgaaggcttttgtgctctgcggaa

SEQ ID NO: 41953 - DNA, 71 bp, chicken (Gallus Gallus)
  misc_feature (36): n=c or t
tttgtttggaatttgttgatggaaactgtggccagntaaacagcaatctcctgatgttacttttctgtcaa

SEQ ID NO: 41954 - DNA, 71 bp, chicken (Gallus Gallus)
  misc_feature (36): n=a or g
atgtttgtgttgcttcacagcgctaatcagcaatcngcatctaaaaagaaagtttggaatcactgctgatg

SEQ ID NO: 41955 - DNA, 71 bp, chicken (Gallus Gallus)
  misc_feature (36): n=a or g
catacatagtttggtacacatattatttacccagcnctggggccgtcagagtccttcaagcaaacagattt

SEQ ID NO: 41956 - DNA, 71 bp, chicken (Gallus Gallus)
  misc_feature (36): n=g or t
tttcccgcttttaatgttacaacaaaaaaaattggntacatatttatatattctcatcagcagaagtcaaa

SEQ ID NO: 41957 - DNA, 71 bp, chicken (Gallus Gallus)
  misc_feature (36): n=c or t
aattttagctctcacatcatgaaaataagaaggctntgctggattccagccccgcatccagacttgaaacc

SEQ ID NO: 41958 - DNA, 71 bp, chicken (Gallus Gallus)
  misc_feature (36): n=a or g
aatatgaaaatgccattgtcttaacaataagcagcnttttgaaaatatttacacacaagtgttacctatta

SEQ ID NO: 41959 - DNA, 71 bp, chicken (Gallus Gallus)
  misc_feature (36): n=c or t
ggtaatgtgtccagattctactgatgtactaaatgngtttctgtcttgctttattatttactgttgttctc

SEQ ID NO: 41960 - DNA, 71 bp, chicken (Gallus Gallus)
  misc_feature (36): n=a or g
ttcattttatgagtcctcgcattgggtccagactcntactattatcaaagtaaaggctgtattaatgaata

SEQ ID NO: 41961 - DNA, 71 bp, chicken (Gallus Gallus)
  misc_feature (36): n=c or t
attcttaataacattcttttagtgcatatttaaaangtatgatgtgatctcttaccacaatggaaaactac

SEQ ID NO: 41962 - DNA, 71 bp, chicken (Gallus Gallus)
  misc_feature (36): n=a or g
caaaggaactgtaaggagtggggtactgcataggtnttatgcatatggcactaaaagaggcaggtgtacat

SEQ ID NO: 41963 - DNA, 71 bp, chicken (Gallus Gallus)
  misc_feature (36): n=a or g
ttacttcctttaacgtgagttaagttcactcatagnaatagcagcttgggacagagatttgtgaaaacgag

SEQ ID NO: 41964 - DNA, 71 bp, chicken (Gallus Gallus)
  misc_feature (36): n=c or t
acaggtattagaagctgaaattcatgactttgcttngtggtatcctcacaccaaaatattgaataactata

SEQ ID NO: 41965 - DNA, 71 bp, chicken (Gallus Gallus)
  misc_feature (36): n=c or t
caagcccatatctcatccagaaggtgagggtgccanatcccttagatgagaatagcgggttgtgtgttggc

SEQ ID NO: 41966 - DNA, 71 bp, chicken (Gallus Gallus)
  misc_feature (36): n=a or g
aaacaatgctaccatgacatccatgtctacaggacngtatggttccttggtgcatatcttattccaagact

SEQ ID NO: 41967 - DNA, 71 bp, chicken (Gallus Gallus)
  misc_feature (36): n=c or t
ataatgatacaggagttcagcacactagaatgattntattccatgtatagaaacagttctgccctgtacag

SEQ ID NO: 41968 - DNA, 71 bp, chicken (Gallus Gallus)
  misc_feature (36): n=a or g
ttgttaatcattaaatgttcttttcatgtaggatcngcttacaactaatcattttcctaaggtgtaaggtc

SEQ ID NO: 41969 - DNA, 71 bp, chicken (Gallus Gallus)
  misc_feature (36): n=c or t
ctgccaagtttttgtactaggctatcaagtctttanattggtttctaaagtcatttatgtctgaaagctct

SEQ ID NO: 41970 - DNA, 71 bp, chicken (Gallus Gallus)
  misc_feature (36): n=a or c
agaaggagtgcagcaaaatttattatctcaaaaaangaaacaagtagaccataatttttaaaggctttgct

SEQ ID NO: 41971 - DNA, 71 bp, chicken (Gallus Gallus)
  misc_feature (36): n=g or t
atgattccatcattatatggagcagcaggtgagganggtgaggtccaagagacaaagagagacatcaaggg

SEQ ID NO: 41972 - DNA, 71 bp, chicken (Gallus Gallus)
  misc_feature (36): n=c or t
cccttcctttcatggaatttacagcaagtgggatanggatgttttcttgaaagtggaagtttgaattcttt

SEQ ID NO: 41973 - DNA, 71 bp, chicken (Gallus Gallus)
  misc_feature (36): n=a or g
tgtaacaaaagaggactgaagccatctgcagctgtntgaggtcatcccagttcaataatagtatctgaaag

SEQ ID NO: 41974 - DNA, 71 bp, chicken (Gallus Gallus)
  misc_feature (36): n=g or t
acaatatatattttgtctttggcagtcctaattttnttcactttctaggtaaactttgatagaagctattt

SEQ ID NO: 41975 - DNA, 71 bp, chicken (Gallus Gallus)
  misc_feature (36): n=c or t
ggataagcactgcatattattcctgatgcaatttangagagagaactccattatggcaaggcaactgtagc

SEQ ID NO: 41976 - DNA, 71 bp, chicken (Gallus Gallus)
  misc_feature (36): n=a or g
ggaatcattgtgttggtgtctccacttcccagatcntagctgaagtaaggcagtccattctttatctgaac

SEQ ID NO: 41977 - DNA, 71 bp, chicken (Gallus Gallus)
  misc_feature (36): n=c or t
cagagacatcttgccttctaccacctttccacacanaacacgcttatcacttatcaaaggtgtaacagagg

SEQ ID NO: 41978 - DNA, 71 bp, chicken (Gallus Gallus)
  misc_feature (36): n=a or g
aggcatgagactaatttacaccatgacacacttatnccatgtgacatctcctattctctggattcttaatg

SEQ ID NO: 41979 - DNA, 71 bp, chicken (Gallus Gallus)
  misc_feature (36): n=g or t
aagaagtataggaaaatacttctcttcctgttagtnttacactcaaatctcactttctatcctgaacacat

SEQ ID NO: 41980 - DNA, 71 bp, chicken (Gallus Gallus)
  misc_feature (36): n=a or g
tacaacaacttcttgccttactcaatgtgagtcacnaaaggaacaaaggatagctatctgcattaaattct

SEQ ID NO: 41981 - DNA, 71 bp, chicken (Gallus Gallus)
  misc_feature (36): n=c or t
cagtaaacaggttctgaacgaagaatctgcatcacntgctctatatttgctactatttcaggaggctggaa

SEQ ID NO: 41982 - DNA, 71 bp, chicken (Gallus Gallus)
  misc_feature (36): n=c or t
caacattacttttgagattactcaggtactccaagncaatctctctttttctaaccctctgcagtaaaata

SEQ ID NO: 41983 - DNA, 71 bp, chicken (Gallus Gallus)
  misc_feature (36): n=c or t
cctattcctggaagtacataactatatttctcagcnaaccccctaggatatcaacttctatcttcagtttt

SEQ ID NO: 41984 - DNA, 71 bp, chicken (Gallus Gallus)
  misc_feature (36): n=c or t
ctccaggacttgttgaagtcacgcttttcaaacttnttgcactgcaaaggaatttagtacctttttgcctg

SEQ ID NO: 41985 - DNA, 71 bp, chicken (Gallus Gallus)
  misc_feature (36): n=a or g
aagattactgattccttacacttacggtagagagtnctgaaatggtacttaagaagtcctgttctgcagag

SEQ ID NO: 41986 - DNA, 71 bp, chicken (Gallus Gallus)
  misc_feature (36): n=a or g
catttggagctgtcctcatatagattgaactgatcntcatgaaattcctactatctgtaaagctataattt

SEQ ID NO: 41987 - DNA, 71 bp, chicken (Gallus Gallus)
  misc_feature (36): n=a or g
aaaaatatttactcacctcagtcactatgaataaancaaaggattgacaaatcatctgtgacactttttct

SEQ ID NO: 41988 - DNA, 71 bp, chicken (Gallus Gallus)
  misc_feature (36): n=a or g
aaaacagaaaccattaacagtcaatttcataatcantggaaacaggggaagaaaatgttaacaaatgcttg

SEQ ID NO: 41989 - DNA, 71 bp, chicken (Gallus Gallus)
  misc_feature (36): n=c or t
aagctgcaccccagcactgatgggagaagctatttnccgtcagtaactctttcctttatgctacataaaca

SEQ ID NO: 41990 - DNA, 71 bp, chicken (Gallus Gallus)
  misc_feature (36): n=c or t
tcataaccactgatggatacactgtgattcacccgntatgtttcccaaagaccagctctcaatggcccttg

SEQ ID NO: 41991 - DNA, 71 bp, chicken (Gallus Gallus)
  misc_feature (36): n=c or t
tgaaattaggctgagtcagcatgtaatgcaagttgncttttccttatgctatctctcaacacaacaagagt

SEQ ID NO: 41992 - DNA, 71 bp, chicken (Gallus Gallus)
  misc_feature (36): n=a or g
atcccagaatatctgcaaataaaaagagctgttacnagttaggtgttgaatcagcaacttcacaggaaact

SEQ ID NO: 41993 - DNA, 71 bp, chicken (Gallus Gallus)
  misc_feature (36): n=a or g
cctgtaattattcacttaagcattctaaaaccaaangcaagggtagcattttcattgcaagtaattctaag

SEQ ID NO: 41994 - DNA, 71 bp, chicken (Gallus Gallus)
  misc_feature (36): n=a or g
ccccatcagcacctaatgcctaatctcccttttagntgctttggtcttatgtatgtgatgtcagttttgtg

SEQ ID NO: 41995 - DNA, 71 bp, chicken (Gallus Gallus)
  misc_feature (36): n=a or g
agtatttgctaatatactgtgaattactgctgtgancagcattcactgatatttatttcagctaattatac

SEQ ID NO: 41996 - DNA, 71 bp, chicken (Gallus Gallus)
  misc_feature (36): n=a or g
accagagtgacaatagaataacttatgcacgtccantatactcttcatacataaactctcaatataataga

SEQ ID NO: 41997 - DNA, 71 bp, chicken (Gallus Gallus)
  misc_feature (36): n=c or t
gcagaaaatcgactttgattcactagagttgtgcangtcatttttcaacatatgaaaatgttctattgaaa

SEQ ID NO: 41998 - DNA, 71 bp, chicken (Gallus Gallus)
  misc_feature (36): n=a or g
gatttttgctcagaccagtctccaagtgacttccantgaggctgaggtggtgaccaagtgcttgttacctg

SEQ ID NO: 41999 - DNA, 71 bp, chicken (Gallus Gallus)
  misc_feature (36): n=a or g
ctgcatgaaattatttggtaggatggtttaaagaanaaaggaaaattacacaatgcagaactaagctctgg

SEQ ID NO: 42000 - DNA, 71 bp, chicken (Gallus Gallus)
  misc_feature (36): n=a or c
ggtgtctagatctggaaatatattgctaatttagtnattcctgtaaagaagcaggggtacttgaaggaaaa

SEQ ID NO: 42001 - DNA, 71 bp, chicken (Gallus Gallus)
  misc_feature (36): n=g or t
acaaagaatttaataatcctcctgcaaaacatgctntagtttatagaaggcaacagtgaagaactgagttt

SEQ ID NO: 42002 - DNA, 71 bp, chicken (Gallus Gallus)
  misc_feature (36): n=a or g
aaaaaagatcagataattgaaatccacagtagaacncagtaatctatcttttataccaaatgagttttgat

SEQ ID NO: 42003 - DNA, 71 bp, chicken (Gallus Gallus)
  misc_feature (36): n=a or g
ttaacgtgcgcgtcttcatatgtgaatgtaaaaagnatttcagagagagtgtaggcttttgtcctagtgaa

SEQ ID NO: 42004 - DNA, 71 bp, chicken (Gallus Gallus)
  misc_feature (36): n=a or g
aggacagaaattcttctcttccaggtaacctgtgtntctcacttcaaaatctctgcttacagtcatacaaa

SEQ ID NO: 42005 - DNA, 71 bp, chicken (Gallus Gallus)
  misc_feature (36): n=a or g
ttgagctacgttgtgaaataagagcttgtgcagganggtagaacatacacgagcatatttttgtattgtat

SEQ ID NO: 42006 - DNA, 71 bp, chicken (Gallus Gallus)
  misc_feature (36): n=a or g
aaaccggatcgctagaagaagctcgagcctggctgngtcagtacacagagggtccagctagtgtgatacag

SEQ ID NO: 42007 - DNA, 71 bp, chicken (Gallus Gallus)
  misc_feature (36): n=c or t
gacctgtgctgtcagtaagtgaaactaggtatgtangtacgtcctgtatgtgcaggagttctctttccagt

SEQ ID NO: 42008 - DNA, 71 bp, chicken (Gallus Gallus)
  misc_feature (36): n=c or t
cttttttttttatggtatcatctttaactcttccangatccaatatgtcaaaggaatatcagtcacttttg

SEQ ID NO: 42009 - DNA, 71 bp, chicken (Gallus Gallus)
  misc_feature (36): n=a or g
actttttcctcctaaacttctatttgttttatttgntgtgatttatgttagtttctgttggtcatttccag

SEQ ID NO: 42010 - DNA, 71 bp, chicken (Gallus Gallus)
  misc_feature (36): n=a or g
gaaaagtgatggaactacctcatcattcagaatttntgccatctattaaaaccatggagaatactgcactg

SEQ ID NO: 42011 - DNA, 71 bp, chicken (Gallus Gallus)
  misc_feature (36): n=a or g
ttctatttcctcttgcacctgcctgcttcttaaagnctgctgtgtaaatcctgagagatggaaagtaagga

SEQ ID NO: 42012 - DNA, 71 bp, chicken (Gallus Gallus)
  misc_feature (36): n=a or g
ttgaatacatattaaaagcatttgatgtgaagatgnaggatctgcaattcattcatgagacagctgttttt

SEQ ID NO: 42013 - DNA, 71 bp, chicken (Gallus Gallus)
  misc_feature (36): n=a or c
taacatcatgtaacatggtaaatattcttatatggnttcaggaatcctcaatttgatggaaattgccatgt

SEQ ID NO: 42014 - DNA, 71 bp, chicken (Gallus Gallus)
  misc_feature (36): n=g or t
gaatatgccacttacgttggattatgaaaaatatcntatgatggtgtgacatgctaagagcaagttgtgta

SEQ ID NO: 42015 - DNA, 71 bp, chicken (Gallus Gallus)
  misc_feature (36): n=a or g
gtggtggtagtgctttgaaatctaagttgtaccacngctcattgcactgcagggtaaggaaaaaggggccc

SEQ ID NO: 42016 - DNA, 71 bp, chicken (Gallus Gallus)
  misc_feature (36): n=a or g
tgatgaaatctaccatgcaactctagggcacctctntcatgtcttttcatggcccttaagatctctaagtg

SEQ ID NO: 42017 - DNA, 71 bp, chicken (Gallus Gallus)
  misc_feature (36): n=a or g
tttctcagctggagttttggaaacaggagatccggnggaattggcagagacggtctctgtgttttgcttgg

SEQ ID NO: 42018 - DNA, 71 bp, chicken (Gallus Gallus)
  misc_feature (36): n=g or t
aggaatgagagcatgggaattaaaatcttcttcatntgccatgtggtgctcagtgtgattgttactgatgt

SEQ ID NO: 42019 - DNA, 71 bp, chicken (Gallus Gallus)
  misc_feature (36): n=a or g
tcagaaaataaatgaccgttgtaaaacacagtatcnggtaaaacttttaaacacaatataatgctgactgc

SEQ ID NO: 42020 - DNA, 71 bp, chicken (Gallus Gallus)
  misc_feature (36): n=c or t
ttttttttccccccggggcacagttctgccgtgctnctctcttacagaaacccgagctgtcccgtgcttac

SEQ ID NO: 42021 - DNA, 71 bp, chicken (Gallus Gallus)
  misc_feature (36): n=c or t
taatatctaaaagctggtgcctactttaagaagcancatggcttaaggtgatacaggaaccccctgtattc

SEQ ID NO: 42022 - DNA, 71 bp, chicken (Gallus Gallus)
  misc_feature (36): n=c or t
aaacaaaaaagagatccttgagtatctttcttctanctcgaaacaagaaataaatacgatatggcagagca

SEQ ID NO: 42023 - DNA, 71 bp, chicken (Gallus Gallus)
  misc_feature (36): n=a or g
aggacaaaatttggaacaagaagtacctactcatcntgtgtagtgtaagaaacgagattcaagctagcagc

SEQ ID NO: 42024 - DNA, 71 bp, chicken (Gallus Gallus)
  misc_feature (36): n=c or t
atactttttccgtgatggtctggccaatgtgaacangatttctgggctcagggagacaccttctatatgtt

SEQ ID NO: 42025 - DNA, 71 bp, chicken (Gallus Gallus)
  misc_feature (36): n=g or t
gcaagaatagaaagcatgtatggtgaagagcaaatngttcatggagattattatttgcaccatgatgtcgt

SEQ ID NO: 42026 - DNA, 71 bp, chicken (Gallus Gallus)
  misc_feature (36): n=c or t
aaataaacaatttggtctctgaggaagatacataanttctcattgtgtaaaatactagcaaccattttaat

SEQ ID NO: 42027 - DNA, 71 bp, chicken (Gallus Gallus)
  misc_feature (36): n=a or g
tcataattagtagcatcattttataattattgatgntatcctgtctgcaactcattttttgaaatgtataa

SEQ ID NO: 42028 - DNA, 71 bp, chicken (Gallus Gallus)
  misc_feature (36): n=a or g
tggttgtttgaaaaagaccagatcacacagttcaantcttcggaagaaaacagttccaggtgtaggcattg

SEQ ID NO: 42029 - DNA, 71 bp, chicken (Gallus Gallus)
  misc_feature (36): n=c or t
aaagagaaattattgatgcattggttactagacagnaagtttaacagtaatattttgatcttctgtttgtt

SEQ ID NO: 42030 - DNA, 71 bp, chicken (Gallus Gallus)
  misc_feature (36): n=c or t
taccagacatttacatgaaaaaggcaacttgtaganactgaactgtaacatttgatctggaaggtggcacc

SEQ ID NO: 42031 - DNA, 71 bp, chicken (Gallus Gallus)
  misc_feature (36): n=a or g
ttaatcacatcttggtcttcccatgatgatttttcnagacctgtaaccctcaatttgaactttgtgtctat

SEQ ID NO: 42032 - DNA, 71 bp, chicken (Gallus Gallus)
  misc_feature (36): n=a or g
tttaattcatccacctacgcaagctactcaaccttnccagaagggtataaacaccaaattttaaatcttct

SEQ ID NO: 42033 - DNA, 71 bp, chicken (Gallus Gallus)
  misc_feature (36): n=a or c
actgcaaaatattcttacaaaatgagtagattttgnggaagtctctcttaaatagtagtccacatgactaa

SEQ ID NO: 42034 - DNA, 71 bp, chicken (Gallus Gallus)
  misc_feature (36): n=c or t
ttttctggaaggcacattgaattgctaactaattgnattcacactatttgccatatcatcaatggggacca

SEQ ID NO: 42035 - DNA, 71 bp, chicken (Gallus Gallus)
  misc_feature (36): n=c or t
aatattcagaaatagttaaaatagtgtttcagttcnattctttgcattttgtattctaatcaaatcatatc

SEQ ID NO: 42036 - DNA, 71 bp, chicken (Gallus Gallus)
  misc_feature (36): n=a or g
atacaaatactacaattctggccattagtatcaccntcttagtccttctaaatcttcagttacagtagaaa

SEQ ID NO: 42037 - DNA, 71 bp, chicken (Gallus Gallus)
  misc_feature (36): n=c or t
gttcctcattttacttggaccttttcctcctacacnggctagaaccttagttgttagttttgccttcagat

SEQ ID NO: 42038 - DNA, 71 bp, chicken (Gallus Gallus)
  misc_feature (36): n=a or g
tgtgtgctttgtatatgacttgggacagtgcgaatntttagtaaatctgaaaacactgggtttccatggga

SEQ ID NO: 42039 - DNA, 71 bp, chicken (Gallus Gallus)
  misc_feature (36): n=c or t
ttgaagccacgtatactgttgtgctgtagaaacaanatttgacgacaagtgttacatcaaacttaacgcca

SEQ ID NO: 42040 - DNA, 71 bp, chicken (Gallus Gallus)
  misc_feature (36): n=c or t
cagtctgtgattctgaaatctttaatatagtttcanctgggctctcaaaaatgatgcaaatgatgcgtttc

SEQ ID NO: 42041 - DNA, 71 bp, chicken (Gallus Gallus)
  misc_feature (36): n=a or g
tgtctgtattagcatatggtgattagtttgtttctntaaaattatttaattgcctatcaccttctgtatct

SEQ ID NO: 42042 - DNA, 71 bp, chicken (Gallus Gallus)
  misc_feature (36): n=a or g
tctgacctcctgcatttactagcaacattgaacagntgcttgtcagcaaccttaacctcagagagcaaaca

SEQ ID NO: 42043 - DNA, 71 bp, chicken (Gallus Gallus)
  misc_feature (36): n=a or g
gactgtgacctgacagtaaattatatagaactgaanaagtgtgagaatgaggataaatgattttattatta

SEQ ID NO: 42044 - DNA, 71 bp, chicken (Gallus Gallus)
  misc_feature (36): n=c or t
agatctagatggccacagatggccaatgtgattaanagtctattttgaagattttctctggaaatatttga

SEQ ID NO: 42045 - DNA, 71 bp, chicken (Gallus Gallus)
  misc_feature (36): n=a or g
aatatttgccaaaataattatcattacagctttcanagatgtgtgatgaaatgtactttgcaccttcatag

SEQ ID NO: 42046 - DNA, 71 bp, chicken (Gallus Gallus)
  misc_feature (36): n=c or t
tgttttctttgaatttctgcagctatgatatttcanaccaatatgaaaacaacattcatgttaccagtgac

SEQ ID NO: 42047 - DNA, 71 bp, chicken (Gallus Gallus)
  misc_feature (36): n=c or t
aatttgtccatgatagtaaggagttatcacaccaanaaagaaaggaacaggattaagagaaaactgaagag

SEQ ID NO: 42048 - DNA, 71 bp, chicken (Gallus Gallus)
  misc_feature (36): n=c or t
agagacgtaaaatggagaatagtgtctgttatgttnttgctcaaaaaagcccatgtgccttttagacactg

SEQ ID NO: 42049 - DNA, 71 bp, chicken (Gallus Gallus)
  misc_feature (36): n=a or g
agattattttctttcttcttgcaattttcctttgcntctattaatgctcttgccaagtctctgtatacata

SEQ ID NO: 42050 - DNA, 71 bp, chicken (Gallus Gallus)
  misc_feature (36): n=a or c
agctgcctaataatgaggctagcctaaggttcctgntaaagttgctttcactcttattccactagctcatt

SEQ ID NO: 42051 - DNA, 71 bp, chicken (Gallus Gallus)
  misc_feature (36): n=c or t
attttcaatctagactggccagtttctaataaaganccttcctactcaaaataagtctgcccttcaaactt

SEQ ID NO: 42052 - DNA, 71 bp, chicken (Gallus Gallus)
  misc_feature (36): n=a or g
cctcacctatcatctttgacaatgccaacacttacnctccatattctccgaagctcttcaatttaaggagc

SEQ ID NO: 42053 - DNA, 71 bp, chicken (Gallus Gallus)
  misc_feature (36): n=c or t
aaaaattgcttttactataagaattgtaaaatgtgntatctcctttgtggacagtgttgtcttatgtttgc

SEQ ID NO: 42054 - DNA, 71 bp, chicken (Gallus Gallus)
  misc_feature (36): n=c or t
tatagagcttataacatttgttgttttcccaagaantacagatctctgatgagatcatatgattggttatt

SEQ ID NO: 42055 - DNA, 71 bp, chicken (Gallus Gallus)
  misc_feature (36): n=c or t
tgaagaagccaagatatggcagaattagtgacaaancacctggcagagtgtaacttcaaaactgcagctgc

SEQ ID NO: 42056 - DNA, 71 bp, chicken (Gallus Gallus)
  misc_feature (36): n=a or g
agctgctcatttgtagctctacagcaaggaacaggnagacattctttcagtttgtgaagtgtcctgctgtg

SEQ ID NO: 42057 - DNA, 71 bp, chicken (Gallus Gallus)
  misc_feature (36): n=a or g
atatattttagtacaacaaatcaaataaataatcanttaaacattttcccacaaactagaatctgaacaac

SEQ ID NO: 42058 - DNA, 71 bp, chicken (Gallus Gallus)
  misc_feature (36): n=c or t
tcactctgtgagtcctacccagagattcacatcctngccaggcttcagtccctccttttccgcagagaagt

SEQ ID NO: 42059 - DNA, 71 bp, chicken (Gallus Gallus)
  misc_feature (36): n=c or t
ttttcatttcactcagtctgttaagtgtgtactgangaattaccatcatgaagcattaatgttatttatgc

SEQ ID NO: 42060 - DNA, 71 bp, chicken (Gallus Gallus)
  misc_feature (36): n=a or g
aaaatcgtttaaaatcttaaagttctttattaagtngaagtcgtctcaatctagccctagtatcaaagcag

SEQ ID NO: 42061 - DNA, 71 bp, chicken (Gallus Gallus)
  misc_feature (36): n=a or g
caggaaatagtgcatggcaccaggggataattcacntgagtaaagttacttgcatgcatatttatgtgcaa

SEQ ID NO: 42062 - DNA, 71 bp, chicken (Gallus Gallus)
  misc_feature (36): n=a or g
cagtagttcaggaattttaggatatggctgatggtncgtacacgcatttcatgagttcttactgcttatta

SEQ ID NO: 42063 - DNA, 71 bp, chicken (Gallus Gallus)
  misc_feature (36): n=a or g
actcatttgcaccgcaaatggggagaagcttttcanactgaacaaatgtcttcacacacagcccctcttca

SEQ ID NO: 42064 - DNA, 71 bp, chicken (Gallus Gallus)
  misc_feature (36): n=a or g
aatgattgcagaggacttgattttggtcctgcgttntatgctttctgcaatgccaggcatagctaggtcac

SEQ ID NO: 42065 - DNA, 71 bp, chicken (Gallus Gallus)
  misc_feature (36): n=a or g
aaaagaataacattccaattctgaacactaaaactntggcatccattattatttctggtatggtaaaacac

SEQ ID NO: 42066 - DNA, 71 bp, chicken (Gallus Gallus)
  misc_feature (36): n=a or g
tttgttttactttttccaagacacagaaacagagcnaaggagaatagcccagactgtgatctttttatagt

SEQ ID NO: 42067 - DNA, 71 bp, chicken (Gallus Gallus)
  misc_feature (36): n=c or t
ctctccaaaaatgagatgaataacgtttgttaccangaggttaattggaaagcgctgtctgggagtggata

SEQ ID NO: 42068 - DNA, 71 bp, chicken (Gallus Gallus)
  misc_feature (36): n=c or t
cagattagactacttaccaagctgtgaaagaaactnactacttcaaagaggagatgaaatgaatctaaagg

SEQ ID NO: 42069 - DNA, 71 bp, chicken (Gallus Gallus)
  misc_feature (36): n=a or g
tgtttatgccacaatattatggtcagaggtgtctcngaagaggtgactggcatgtgctcttcctcatttac

SEQ ID NO: 42070 - DNA, 71 bp, chicken (Gallus Gallus)
  misc_feature (36): n=a or g
tcaaaataccttgcaaaatgcttgtgggaagaaacntaaggtattccctgtgtcactaatctaatttgtaa

SEQ ID NO: 42071 - DNA, 71 bp, chicken (Gallus Gallus)
  misc_feature (36): n=a or g
aaactcactcaaggagagataaaacaagttaagagntaaggaaatcttttgtgcattgttaggacaagaac

SEQ ID NO: 42072 - DNA, 71 bp, chicken (Gallus Gallus)
  misc_feature (36): n=c or t
aaagtgtaactccaagcaagatgatcaggagaatcncaagatgagttttacagactcttgctgacccccac

SEQ ID NO: 42073 - DNA, 71 bp, chicken (Gallus Gallus)
  misc_feature (36): n=g or t
actttaccccaagcatcaataagaacaacacatttntaataaccaaatcatcaagaacaagaacttggtca

SEQ ID NO: 42074 - DNA, 71 bp, chicken (Gallus Gallus)
  misc_feature (36): n=c or t
cactccagttccactggaagtgcagagaaagtcctnatggcctcctcagggcacagcaatgcacctcacca

SEQ ID NO: 42075 - DNA, 71 bp, chicken (Gallus Gallus)
  misc_feature (36): n=a or g
gaagcaaaagtcagtgaactcttaaattgtctcctnctgtctgtctgtattgggcagtaggatgcttgggt

SEQ ID NO: 42076 - DNA, 71 bp, chicken (Gallus Gallus)
  misc_feature (36): n=c or t
aaaaggagctgctgtagtatctgtcaaaaattatanacgttttaggtagcatgccttgtgtggtatgaaat

SEQ ID NO: 42077 - DNA, 71 bp, chicken (Gallus Gallus)
  misc_feature (36): n=c or t
gtacgctattatcaaatgcagcgtcagagtgactgnaggaatgctgcccgaactaccattcgcttgttgga

SEQ ID NO: 42078 - DNA, 71 bp, chicken (Gallus Gallus)
  misc_feature (36): n=c or t
ggtaagcttgtgcaagtgctcttagtgcaggtaagngctatgaggtgcagaggcacaaacgaagtggctca

SEQ ID NO: 42079 - DNA, 71 bp, chicken (Gallus Gallus)
  misc_feature (36): n=a or g
tgttactgtttcatttgacagtgtggaagagagaangtaagttgcatacattgctgtagtattctccagta

SEQ ID NO: 42080 - DNA, 71 bp, chicken (Gallus Gallus)
  misc_feature (36): n=c or t
tatggtcgtgaaagtagattgaccacattacttagncctccctaacacttttggaaataaaaacatcactc

SEQ ID NO: 42081 - DNA, 71 bp, chicken (Gallus Gallus)
  misc_feature (36): n=a or g
agatgatttaaatcttcccctttctgaattttaccngatgactttgaaacaaatagtagagtgaaggtttg

SEQ ID NO: 42082 - DNA, 71 bp, chicken (Gallus Gallus)
  misc_feature (36): n=a or g
catcaaaagctgaatcatgtgaatcactcaataccntaatttcaaagaattcactgcaaataaaaaaaact

SEQ ID NO: 42083 - DNA, 71 bp, chicken (Gallus Gallus)
  misc_feature (36): n=c or t
agctgatgcagcccagatgcttctctgcctttctanttctgcgattccataggcctccaagaaaagaagcc

SEQ ID NO: 42084 - DNA, 71 bp, chicken (Gallus Gallus)
  misc_feature (36): n=c or t
cttcagcttagtccccatctcccctggctcacttangattttcagtagactgaattcaaaatgacaccctg

SEQ ID NO: 42085 - DNA, 71 bp, chicken (Gallus Gallus)
  misc_feature (36): n=g or t
aatgtcaggtagaggtgccattataagtagagcctngagaaatccacctgatatgcaagcccctgtaactc

SEQ ID NO: 42086 - DNA, 71 bp, chicken (Gallus Gallus)
  misc_feature (36): n=a or g
tgtgtactgtggacacaggatatgcatacgccacancccattgcagccctaaaatttgaattcagcaattc

SEQ ID NO: 42087 - DNA, 71 bp, chicken (Gallus Gallus)
  misc_feature (36): n=c or t
ttttggcaggagacagctgtaaaccatctgctttgnatttccatctgtacaaatgaccatctctgtcatcc

SEQ ID NO: 42088 - DNA, 71 bp, chicken (Gallus Gallus)
  misc_feature (36): n=g or t
tcacctaaaataattggagaattgaagattgatttntgtatgtatatgcacagataaatcacattataggt

SEQ ID NO: 42089 - DNA, 71 bp, chicken (Gallus Gallus)
  misc_feature (36): n=a or c
caaggtcatggcccatccttgtttccaccacacccnccatcaaaaaagggcactgctgtgcaagcacgagg

SEQ ID NO: 42090 - DNA, 71 bp, chicken (Gallus Gallus)
  misc_feature (36): n=c or t
tgtttaccggatagattctcttaagtcactactagnttttagttatagataactgatattaatggtagacc

SEQ ID NO: 42091 - DNA, 71 bp, chicken (Gallus Gallus)
  misc_feature (36): n=c or t
aagggcaggactgactgagcccatatgtgtgcttcngattgttatcaagggacaagtgggggtgtgggggg

SEQ ID NO: 42092 - DNA, 71 bp, chicken (Gallus Gallus)
  misc_feature (36): n=a or g
aagaaccaagctgtattttcagacagtgaaggcatnagagccacactaagatgaaatgcagtgattataag

SEQ ID NO: 42093 - DNA, 71 bp, chicken (Gallus Gallus)
  misc_feature (36): n=a or g
ttagacttatatagttttgtcagtatcaaggagagnagacagcattttctcagtactttaaaagttgcaaa

SEQ ID NO: 42094 - DNA, 71 bp, chicken (Gallus Gallus)
  misc_feature (36): n=g or t
gcatcacctcagtccttcaatgcccataatttgtantctccacacagtttccaatcagcatgagttttata

SEQ ID NO: 42095 - DNA, 71 bp, chicken (Gallus Gallus)
  misc_feature (36): n=a or g
ctactttacttttgaaacataaaaccttgttttccnaattgtgaagcagagaagatacatttataggatat

SEQ ID NO: 42096 - DNA, 71 bp, chicken (Gallus Gallus)
  misc_feature (36): n=g or t
tttcaaaggatctctaagtgtttcacaatcaagaantaattaaacatttcagtaatgtctctgcaatatag

SEQ ID NO: 42097 - DNA, 71 bp, chicken (Gallus Gallus)
  misc_feature (36): n=c or t
catatttaggaaattacctgaattcctgtcaaggcngagagtctttgtaaaacagtttcttttgcatcttt

SEQ ID NO: 42098 - DNA, 71 bp, chicken (Gallus Gallus)
  misc_feature (36): n=a or g
atgctataatgaaaagctgttttcagagatccgatngtttgcaaccctaagtcactttgaaagtagctagg

SEQ ID NO: 42099 - DNA, 71 bp, chicken (Gallus Gallus)
  misc_feature (36): n=c or t
catttatattgtaatgtgcagagaaaactgtttgantgaatattcaagctattttatctcttgctgacaga

SEQ ID NO: 42100 - DNA, 71 bp, chicken (Gallus Gallus)
  misc_feature (36): n=a or g
atgtgtgaggcacaactcttgagtcaaaaactacantttctctattgcatcaaccattagctaaactgaat

SEQ ID NO: 42101 - DNA, 71 bp, chicken (Gallus Gallus)
  misc_feature (36): n=a or c
gttggcttaaatgaaagttatgtactacacataggntggctgtacaggatcagctcaaaagtgcatgcact

SEQ ID NO: 42102 - DNA, 71 bp, chicken (Gallus Gallus)
  misc_feature (36): n=c or t
atgtgctaaaatctctcttgactgtttatcatcttngcagtgccttgttgcagtgcatgaatttagtatca

SEQ ID NO: 42103 - DNA, 71 bp, chicken (Gallus Gallus)
  misc_feature (36): n=a or g
cagtttatacttaaaaggttatctccacaaccagangagacagaaactttctgtaaatatatgtgtgtgta

SEQ ID NO: 42104 - DNA, 71 bp, chicken (Gallus Gallus)
  misc_feature (36): n=c or t
caaaaatagaagacattgcatacaacagaaaataancagaaaatacacggaaaaaaaatctgcagaccttt

SEQ ID NO: 42105 - DNA, 71 bp, chicken (Gallus Gallus)
  misc_feature (36): n=c or t
cagaaaccataaatgttgccaaaccacaaatgtttntaccagtgtagctgatttatgcaacatgatggtga

SEQ ID NO: 42106 - DNA, 71 bp, chicken (Gallus Gallus)
  misc_feature (36): n=a or g
ggagggattattagctaaagagctagtttaagacanggatatttgtgtccataattctgccctgtgacgat

SEQ ID NO: 42107 - DNA, 71 bp, chicken (Gallus Gallus)
  misc_feature (36): n=c or t
atgttagcaagaaaatttacaagagagtgtgttggnccaaaacttctaagatgttaaaattgtgttccttg

SEQ ID NO: 42108 - DNA, 71 bp, chicken (Gallus Gallus)
  misc_feature (36): n=c or t
tgaatcactcagtttttttggaaatccaacctactnccaagagcaagtacatggaaataagaactctgcct

SEQ ID NO: 42109 - DNA, 71 bp, chicken (Gallus Gallus)
  misc_feature (36): n=c or t
gaggtgtataggtgtttcttatacttgccaataaantgaatttaataatttcatctgttaaaatacagcac

SEQ ID NO: 42110 - DNA, 71 bp, chicken (Gallus Gallus)
  misc_feature (36): n=a or g
aaagttgcattggtgcaggatccttggctttagcantcgcatcaccgagtggcttgacagaccctgaattt

SEQ ID NO: 42111 - DNA, 71 bp, chicken (Gallus Gallus)
  misc_feature (36): n=g or t
gaattaatatctggaaatcccctgacttgttaacanctctttctatgtttaatttgaaatgcattttgtac

SEQ ID NO: 42112 - DNA, 71 bp, chicken (Gallus Gallus)
  misc_feature (36): n=g or t
cagacttttttactgttgtgtcttataacagatctnaggttgctctatcagtataaagttcttcatagaaa

SEQ ID NO: 42113 - DNA, 71 bp, chicken (Gallus Gallus)
  misc_feature (36): n=c or t
tcaggagatctctcctgaatactttgataattcttngcttataacctgggtgctgtggttgtcatgtccta

SEQ ID NO: 42114 - DNA, 71 bp, chicken (Gallus Gallus)
  misc_feature (36): n=c or t
ggtcagtgaaagcattatatcaagcaggataacttnctttactggaaaatttaagcttggagcagtcagga

SEQ ID NO: 42115 - DNA, 71 bp, chicken (Gallus Gallus)
  misc_feature (36): n=c or t
caagagaaaagattttttgaaatatactgtggtttnctgcttgctaacacaactggatttcattccaatgg

SEQ ID NO: 42116 - DNA, 71 bp, chicken (Gallus Gallus)
  misc_feature (36): n=a or g
agataatgtttgtaaatctcaaagagattctgaggnaaaaattcccttgatgtaaaattcagggaatgctt

SEQ ID NO: 42117 - DNA, 71 bp, chicken (Gallus Gallus)
  misc_feature (36): n=a or g
agaggaaggcttctataatttacttgctgaatgagncctaggaaacacagatttaattcttccctccacta

SEQ ID NO: 42118 - DNA, 71 bp, chicken (Gallus Gallus)
  misc_feature (36): n=a or g
gtgtgctacaccagtcaagactgtaaatagagacangccttaaagtacctcccactgaaccacataaatag

SEQ ID NO: 42119 - DNA, 71 bp, chicken (Gallus Gallus)
  misc_feature (36): n=a or g
atctgattgatcttaaatttctgttttaagacgaanctactcaccctgtgggatatccctgctttcatttg

SEQ ID NO: 42120 - DNA, 71 bp, chicken (Gallus Gallus)
  misc_feature (36): n=a or c
tgtgttagatgctagttaggatttgtctgcctatantgagttagtctcacagagaggtttgcatttgttat

SEQ ID NO: 42121 - DNA, 71 bp, chicken (Gallus Gallus)
  misc_feature (36): n=a or g
aacactcagccagcaagtatactgtaggtagagatntaagtagagctcacttcagctgtctgcacattctg

SEQ ID NO: 42122 - DNA, 71 bp, chicken (Gallus Gallus)
  misc_feature (36): n=c or t
gattagcacactgcaggctagagatgaaaaataggnacatctcactcacatcctaggaaaacttttttgtc

SEQ ID NO: 42123 - DNA, 71 bp, chicken (Gallus Gallus)
  misc_feature (36): n=a or g
agcagcttaagttcctacttttggcaagtcaaacantaacaagcactgggcaaggagctctcttcagtgct

SEQ ID NO: 42124 - DNA, 71 bp, chicken (Gallus Gallus)
  misc_feature (36): n=a or g
cattacttaggcaccagctaattaattctaagtcanttgaaatctggagttcgagtaagggatttttctga

SEQ ID NO: 42125 - DNA, 71 bp, chicken (Gallus Gallus)
  misc_feature (36): n=c or t
gactgaagtggtcttggttcactgtgggtgaagaanagcgagctctgaatggactggcacatggactcctt

SEQ ID NO: 42126 - DNA, 71 bp, chicken (Gallus Gallus)
  misc_feature (36): n=g or t
acagtggtcttgtccagttgcagagtgctgctcttnttgctatgtcagaacacaagcgaatctcctgtttt

SEQ ID NO: 42127 - DNA, 71 bp, chicken (Gallus Gallus)
  misc_feature (36): n=c or t
cctattaaaaaaaaaagctcacaacttttctgcttngcgagaagtctcatgactgaatgataatgactgta

SEQ ID NO: 42128 - DNA, 71 bp, chicken (Gallus Gallus)
  misc_feature (36): n=c or t
agtcagatgcttattattatctagatttcattttgnctctgagtatcacaaactgaattgcatctactaga

SEQ ID NO: 42129 - DNA, 71 bp, chicken (Gallus Gallus)
  misc_feature (36): n=c or t
ggatggagctgtatttctgccataagttcttactcngtatctccagtattaagtacagtttggggtgggta

SEQ ID NO: 42130 - DNA, 71 bp, chicken (Gallus Gallus)
  misc_feature (36): n=a or g
aaccttttaggttttaggtaattttacacgtatagngcctaatgtttttatccttgatgttatgtagtaat

SEQ ID NO: 42131 - DNA, 71 bp, chicken (Gallus Gallus)
  misc_feature (36): n=a or g
ctcatttgaaacaggagagttgaagatgaagagacngagctttgcacatttttcctcacttaaaatttggt

SEQ ID NO: 42132 - DNA, 71 bp, chicken (Gallus Gallus)
  misc_feature (36): n=c or t
ctgaagcactccccttgctgagctgagaacctcacnctcatttacgttattttgctgctgcaacctttgct

SEQ ID NO: 42133 - DNA, 71 bp, chicken (Gallus Gallus)
  misc_feature (36): n=a or g
cacccttcagactccccagtaagaaatgcaactggntgagaaagtgcaagagtaataatctgaagttaaac

SEQ ID NO: 42134 - DNA, 71 bp, chicken (Gallus Gallus)
  misc_feature (36): n=c or t
aaatgtgattagtgctcagattactgttttgtctantattaatcagctgtcacctcatcccatgcataaag

SEQ ID NO: 42135 - DNA, 71 bp, chicken (Gallus Gallus)
  misc_feature (36): n=c or t
ttatttcagactaatggtttggtacttgataacagnttgttttcctcattccttatttgctttgctaagta

SEQ ID NO: 42136 - DNA, 71 bp, chicken (Gallus Gallus)
  misc_feature (36): n=a or c
ccagctgatatgggctttgccagattgttcaattcncctttgaagccgttggcagacttggatccagttgt

SEQ ID NO: 42137 - DNA, 71 bp, chicken (Gallus Gallus)
  misc_feature (36): n=c or t
tctctgtgcatctgagaggcaaaatttctttgttgntattctctgttgactgaaataaggtgtaggcatca

SEQ ID NO: 42138 - DNA, 71 bp, chicken (Gallus Gallus)
  misc_feature (36): n=a or g
cttggtgaaaaatcagaaaactatactattcatctnctgttcagatagtcttttctctataaataaatact

SEQ ID NO: 42139 - DNA, 71 bp, chicken (Gallus Gallus)
  misc_feature (36): n=c or t
ggtattgtaactttctaggagtaaacctgttcttcncaaagcagctggttcagaggggccgagtacctttt

SEQ ID NO: 42140 - DNA, 71 bp, chicken (Gallus Gallus)
  misc_feature (36): n=c or t
gagtcattgattctaagtccccctctgtctcttttnctctgtaattagccatatttggaataagtaggatg

SEQ ID NO: 42141 - DNA, 71 bp, chicken (Gallus Gallus)
  misc_feature (36): n=a or g
cattttaaatatgttctgaggcgtaaccaggaaacnagaggctctgaggtcggactgccagggtacctcat

SEQ ID NO: 42142 - DNA, 71 bp, chicken (Gallus Gallus)
  misc_feature (36): n=a or g
cattgctggtagcagagagcagttttccacagatgnctgtcattatcgtgcaataacacagcaccctctgc

SEQ ID NO: 42143 - DNA, 71 bp, chicken (Gallus Gallus)
  misc_feature (36): n=c or t
tgctccaaaaatatccagatacagggagaaaagcantggatgagtcaccaaaaatccaagctgaagaattt

SEQ ID NO: 42144 - DNA, 71 bp, chicken (Gallus Gallus)
  misc_feature (36): n=a or g
agaagatatgtagaatgaaagcaggtgaaaaagacntctgccagttagaaggaaagagcccatctaggaaa

SEQ ID NO: 42145 - DNA, 71 bp, chicken (Gallus Gallus)
  misc_feature (36): n=g or t
gctacagactcatatagatggcctgaatgtgctctnagcaggcttgtttaggagaacctcaggtcttacct

SEQ ID NO: 42146 - DNA, 71 bp, chicken (Gallus Gallus)
  misc_feature (36): n=c or t
actatttgattctttcacaatactattctgtaatantgcttacaatgactgatacactgtacttacgctgt

SEQ ID NO: 42147 - DNA, 71 bp, chicken (Gallus Gallus)
  misc_feature (36): n=a or g
actttaaaagtccaaaaatatctaagcagctatctntgtagtccacaaagcaacctaaaattattgccttg

SEQ ID NO: 42148 - DNA, 71 bp, chicken (Gallus Gallus)
  misc_feature (36): n=a or c
ccccatagcttgatcaaaacatgttggtaggacatnaaagcagggtgtggaactttctgaatgattgcaat

SEQ ID NO: 42149 - DNA, 71 bp, chicken (Gallus Gallus)
  misc_feature (36): n=c or t
taaagaacatgtcactacgaaaaagtttaattcagngactcacattccacagtatcagcactaagcaagga

SEQ ID NO: 42150 - DNA, 71 bp, chicken (Gallus Gallus)
  misc_feature (36): n=a or g
agcaccatcaaaacaggcagtctgcccagattggcnaggcattgaatgaagatacaaatattttccaaaag

SEQ ID NO: 42151 - DNA, 71 bp, chicken (Gallus Gallus)
  misc_feature (36): n=c or t
tatgatgagctcctccctttattagcgttactattnatactcgacttgaagtaagctgcatgccctaccaa

SEQ ID NO: 42152 - DNA, 71 bp, chicken (Gallus Gallus)
  misc_feature (36): n=c or t
tagatggcagagaactttaaaagctcttgtgattcnatcttcacaaatgctcgagcaaactactgtttgct

SEQ ID NO: 42153 - DNA, 71 bp, chicken (Gallus Gallus)
  misc_feature (36): n=a or g
ttgtaggagcagcggggcaagaaataaatcagcttngggaagctgagaatcacacagtcaccataatgatg

SEQ ID NO: 42154 - DNA, 71 bp, chicken (Gallus Gallus)
  misc_feature (36): n=c or t
cacaaagtcgcacagtttttatttggattcagtccnacattttaaggtacatctacattgcagattttatg

SEQ ID NO: 42155 - DNA, 71 bp, chicken (Gallus Gallus)
  misc_feature (36): n=c or t
aaatgcaataaacaagaaacggaaccagaaagtctnaacagtgacccagtgatgacagagaaaaagggcag

SEQ ID NO: 42156 - DNA, 71 bp, chicken (Gallus Gallus)
  misc_feature (36): n=a or g
gcactatgtttcttgacctgctgtttctaatgaacnaggaggataaatgggtaatttcttgctcctccatt

SEQ ID NO: 42157 - DNA, 71 bp, chicken (Gallus Gallus)
  misc_feature (36): n=a or g
ttctgtgctagtgaacttagcctagagtggatctcncataatgtggttacattactgcattctcaaagctc

SEQ ID NO: 42158 - DNA, 71 bp, chicken (Gallus Gallus)
  misc_feature (36): n=a or g
gcacagcgccaactattggaattccataccaggaancaattgggcggtgcagtgctacgtgtggtttaaaa

SEQ ID NO: 42159 - DNA, 71 bp, chicken (Gallus Gallus)
  misc_feature (36): n=g or t
ttatataagctacaattcaagttccccccctcaaanatatttcagcctttacttagtacctcattatttta

SEQ ID NO: 42160 - DNA, 71 bp, chicken (Gallus Gallus)
  misc_feature (36): n=a or g
gatgcgctctgaaagcctgcttggaagagcagtctnaattcacggagctccactgaaaagatatcctgaag

SEQ ID NO: 42161 - DNA, 71 bp, chicken (Gallus Gallus)
  misc_feature (36): n=a or g
ctttataatcagcttggaaaatagtttagcccacangatctttgtgacttacttctgtcttccccacttta

SEQ ID NO: 42162 - DNA, 71 bp, chicken (Gallus Gallus)
  misc_feature (36): n=c or t
ccaaaagtagatgagattttgaaggtgagaagatcnttgtgtggttttgctcagaggaagctttcatgaac

SEQ ID NO: 42163 - DNA, 71 bp, chicken (Gallus Gallus)
  misc_feature (36): n=a or g
ggaagtgacagggaatctgacagagaacaagatganaaacaaaacaaagacgatgaagctgtaagtcttaa

SEQ ID NO: 42164 - DNA, 71 bp, chicken (Gallus Gallus)
  misc_feature (36): n=a or g
cactgtcagattggcaaaaaaaaaaccttgcttcantgacaatatcttttttcccgggatacctgtgattg

SEQ ID NO: 42165 - DNA, 71 bp, chicken (Gallus Gallus)
  misc_feature (36): n=c or t
gtccaaagaggcacaggcatttcacagcatctactntcaagacaactgtagccaaggccatgccttagcca

SEQ ID NO: 42166 - DNA, 71 bp, chicken (Gallus Gallus)
  misc_feature (36): n=c or t
ctagacacagcctccaattttcatccaaattttagntggcatttaatttctacaactgctgaaagtgaata

SEQ ID NO: 42167 - DNA, 71 bp, chicken (Gallus Gallus)
  misc_feature (36): n=c or t
aagaggtcagcagtgggtgttaatgaagaacccagnctttgctctcagccatacttcacgcagcataacaa

SEQ ID NO: 42168 - DNA, 71 bp, chicken (Gallus Gallus)
  misc_feature (36): n=c or t
agactggcaaatgggcaaatgactctgaaagtcatnccttgctccgtgagtaggatttcgtgccactatga

SEQ ID NO: 42169 - DNA, 71 bp, chicken (Gallus Gallus)
  misc_feature (36): n=a or g
gcttcttaccgggcaggtgggagcacctatgaaatncttccaaagaggaaagttttcaggcagtgctagca

SEQ ID NO: 42170 - DNA, 71 bp, chicken (Gallus Gallus)
  misc_feature (36): n=a or g
atatgaaatattaaatttgaaaataatatgtccacnggagaagcagttttctttgttgacctggcaatggc

SEQ ID NO: 42171 - DNA, 71 bp, chicken (Gallus Gallus)
  misc_feature (36): n=a or g
tactgcagtaccaccaccacctcctcaatctatacnccaaattgaagaatttaggaagtcgggaccatggc

SEQ ID NO: 42172 - DNA, 71 bp, chicken (Gallus Gallus)
  misc_feature (36): n=c or t
aacacagttttggggtggcctatctcttcctcagtngcagggaagaaggaaaagggttcagaggcaggata

SEQ ID NO: 42173 - DNA, 71 bp, chicken (Gallus Gallus)
  misc_feature (36): n=c or t
ctagatgtcactaaatcaacatcccttcaggggctntttctgaagagagaataagttctcccggatgacct

SEQ ID NO: 42174 - DNA, 71 bp, chicken (Gallus Gallus)
  misc_feature (36): n=c or t
taataatatacctacatctggcaagctaggtaagangggaatgtttctgaaaataatgacaccccttttca

SEQ ID NO: 42175 - DNA, 71 bp, chicken (Gallus Gallus)
  misc_feature (36): n=a or g
gggcgtctgcaagcgaaggatctggaggcacaaaancaaaaccccaaatgtaagtgcatagcctgcagcag

SEQ ID NO: 42176 - DNA, 71 bp, chicken (Gallus Gallus)
  misc_feature (36): n=c or t
attatctacttttggcctctgtgcccatgtttttcntcccctcaggtatggggggcagcccatccctaaca

SEQ ID NO: 42177 - DNA, 71 bp, chicken (Gallus Gallus)
  misc_feature (36): n=a or g
caaacctgaatgtatcaagtgaagcatatgctaaanttgggcctatttatgctcgtgggagctctgtctga

SEQ ID NO: 42178 - DNA, 71 bp, chicken (Gallus Gallus)
  misc_feature (36): n=c or t
tgaaacacagacagcatgtgacaaaacagctccttntaatgacgatactagctacgggtaaagcaccttcg

SEQ ID NO: 42179 - DNA, 71 bp, chicken (Gallus Gallus)
  misc_feature (36): n=c or t
ttctgcacagtgtcatggtgcctggcctcctcttgncttccctgatagctactttggcaatcacatactgt

SEQ ID NO: 42180 - DNA, 71 bp, chicken (Gallus Gallus)
  misc_feature (36): n=c or t
gatggggcgtcccatgtatcagtctgtgcccaatgnagcttgttctgtcagtcaaggagaatttaactatc

SEQ ID NO: 42181 - DNA, 71 bp, chicken (Gallus Gallus)
  misc_feature (36): n=a or g
actgtcagccactcatgactgtagtgtttggcactngagatgcctttaattccaaaggtgtgaaatattac

SEQ ID NO: 42182 - DNA, 71 bp, chicken (Gallus Gallus)
  misc_feature (36): n=g or t
gtccagtagtaattgtaggttggctttcctgcctantcaaaaaatcatcgaagtttattttaattactgat

SEQ ID NO: 42183 - DNA, 71 bp, chicken (Gallus Gallus)
  misc_feature (36): n=a or g
gggctccttctgtctgaaagattttagcattagatntgaatgtttagtccactactgttctgtttttttgc

SEQ ID NO: 42184 - DNA, 71 bp, chicken (Gallus Gallus)
  misc_feature (36): n=a or g
ggtttctgaggaaaagtcaaagacttagagaaaggnctgggagctaggaaagacagggaagctaatctcta

SEQ ID NO: 42185 - DNA, 71 bp, chicken (Gallus Gallus)
  misc_feature (36): n=c or t
tgaagaaaatgagttctgaaatgcaaaaacttctgntactaacactttctactcctgaaaaagcagaagga

SEQ ID NO: 42186 - DNA, 71 bp, chicken (Gallus Gallus)
  misc_feature (36): n=a or g
taccattaggaaatgcttttttattcctattgaatncttagaaattagctgaattttaattcttatgtgaa

SEQ ID NO: 42187 - DNA, 71 bp, chicken (Gallus Gallus)
  misc_feature (36): n=c or t
cattcagcatgtctccgagatgatatcacttatgancctagatcatgtgtacttgtaatggattttccttt

SEQ ID NO: 42188 - DNA, 71 bp, chicken (Gallus Gallus)
  misc_feature (36): n=a or g
gcaaagatgatcaaatatacacaggattcccatttntctgtgtaagaactgaggaaggcccacgcatctat

SEQ ID NO: 42189 - DNA, 71 bp, chicken (Gallus Gallus)
  misc_feature (36): n=c or t
tcaacctgcatgttcagaggttcataactcagctanagacatttgcttggcactacaaacacagtttctgc

SEQ ID NO: 42190 - DNA, 71 bp, chicken (Gallus Gallus)
  misc_feature (36): n=a or c
gtaacatttattagttatttacaacatagtatgagntgctcagtcacaaactgtaaagtttgggtacagtc

SEQ ID NO: 42191 - DNA, 71 bp, chicken (Gallus Gallus)
  misc_feature (36): n=a or c
gacagccagttaaaatgtgggatatttaacaaaatnatgttatctcatacatttggaatatagggagacca

SEQ ID NO: 42192 - DNA, 71 bp, chicken (Gallus Gallus)
  misc_feature (36): n=c or t
attatcaaaaccatattctcccctcatttagtctcnggtgaaacagaaggcgttggagatttttgctgtat

SEQ ID NO: 42193 - DNA, 71 bp, chicken (Gallus Gallus)
  misc_feature (36): n=g or t
acttactggtgattttccatggtttagtgttaggtngcccagatgcttggcttaatatgacatctgcctcc

SEQ ID NO: 42194 - DNA, 71 bp, chicken (Gallus Gallus)
  misc_feature (36): n=c or t
gtcaggcctccataaacttatagtgcaaaaatatanacctctttaatgcatgctaagctaaagaagctcaa

SEQ ID NO: 42195 - DNA, 71 bp, chicken (Gallus Gallus)
  misc_feature (36): n=c or t
tataacaaaaaatacattattgtaagatgtcaccanttagctataaaagaagctataaattatttctaatc

SEQ ID NO: 42196 - DNA, 71 bp, chicken (Gallus Gallus)
  misc_feature (36): n=c or t
taagtcctactctataatttgaatttacatggttanggtcttaaatggtaatgtgcacagctcaatctttg

SEQ ID NO: 42197 - DNA, 71 bp, chicken (Gallus Gallus)
  misc_feature (36): n=c or t
atgccctctcacttgaatcttttgtactactctaanagtatctctagtgacaccaaggcataaggagttgt

SEQ ID NO: 42198 - DNA, 71 bp, chicken (Gallus Gallus)
  misc_feature (36): n=c or t
ctgatataaaattagggatggttccaataaaaatantgaattcttaatatgattgttctttgtttttcagt

SEQ ID NO: 42199 - DNA, 71 bp, chicken (Gallus Gallus)
  misc_feature (36): n=a or g
gctgtccataacctcatgcaaacaacattaatcagntacacaagcttgacacaaaaagatgtttattgaac

SEQ ID NO: 42200 - DNA, 71 bp, chicken (Gallus Gallus)
  misc_feature (36): n=a or g
ttcaaaagacacatactgatttctccttggtatctnctaggaaggagtcctgctcttcattcagaaaggga

SEQ ID NO: 42201 - DNA, 71 bp, chicken (Gallus Gallus)
  misc_feature (36): n=c or t
aaagagagccataatatgttaaccctaaatatgttnacacaaacaaatcacctagcaggagaggattttaa

SEQ ID NO: 42202 - DNA, 71 bp, chicken (Gallus Gallus)
  misc_feature (36): n=c or t
acataatttatatttatgaccttagtgagaactggntctattaacttgagtacagatggtcagatatttcc

SEQ ID NO: 42203 - DNA, 71 bp, chicken (Gallus Gallus)
  misc_feature (36): n=c or t
gttgtgtataaaataatagcttatttaaagatctcncagtctgtaaatgttagcatcacttacgccagcct

SEQ ID NO: 42204 - DNA, 71 bp, chicken (Gallus Gallus)
  misc_feature (36): n=a or g
atcgtattaatgaaataatatatcctagagcctganatagcatgacaagcttctgacaatacttctcatgc

SEQ ID NO: 42205 - DNA, 71 bp, chicken (Gallus Gallus)
  misc_feature (36): n=c or t
tcatgtggatcaaaaagctggactgactcttggcanttccctatgatatataaaaccaatagagtttaagg

SEQ ID NO: 42206 - DNA, 71 bp, chicken (Gallus Gallus)
  misc_feature (36): n=c or t
tcttaatcatcatgactggccttagagacaaattgntgttagagttctgttttatacttagatcttgtctt

SEQ ID NO: 42207 - DNA, 71 bp, chicken (Gallus Gallus)
  misc_feature (36): n=a or g
tgacctattgattgtaaggtcaaactcattagtttnaaccaccttcactgaattcaagctaacattttacc

SEQ ID NO: 42208 - DNA, 71 bp, chicken (Gallus Gallus)
  misc_feature (36): n=c or t
atcactaatcctctcctggtgttttaaataaatgantttaagagatgacactaaaaactgctcaaaataaa

SEQ ID NO: 42209 - DNA, 71 bp, chicken (Gallus Gallus)
  misc_feature (36): n=c or t
tttacaaatgtattatatgtattgctaagtatccanatagcacttgaaagaagcagtcctatgaagtgaaa

SEQ ID NO: 42210 - DNA, 71 bp, chicken (Gallus Gallus)
  misc_feature (36): n=c or t
gcagtggaggggtaatatgctagaaaaggagactcnattcttttcagatgtgatgcaaggacagaggtgtc

SEQ ID NO: 42211 - DNA, 71 bp, chicken (Gallus Gallus)
  misc_feature (36): n=a or g
tgaactctaagtcaatgtctttcactgttcagagcnatgccccaaccatcagacaatatacatatatcata

SEQ ID NO: 42212 - DNA, 71 bp, chicken (Gallus Gallus)
  misc_feature (36): n=a or g
ctggatttggcaaaccaatgtctgtgaaattggtgnttagcatgagaacaagtgggaattaccacagcagt

SEQ ID NO: 42213 - DNA, 71 bp, chicken (Gallus Gallus)
  misc_feature (36): n=g or t
gattgaagctgtgaaattacaaacgtatgcatttantttagtacacaaatactctttcagcataaagcact

SEQ ID NO: 42214 - DNA, 71 bp, chicken (Gallus Gallus)
  misc_feature (36): n=a or c
tgtatgcaacagggaagataatcatgtttccagtgnttctgactgacaagcaccagtcaagagtaaggagt

SEQ ID NO: 42215 - DNA, 71 bp, chicken (Gallus Gallus)
  misc_feature (36): n=a or g
aactcacatggagagaacaggtatatttacaacacnttttaagcaactgagcagataagtaaatttaagaa

SEQ ID NO: 42216 - DNA, 71 bp, chicken (Gallus Gallus)
  misc_feature (36): n=c or t
gcctcatggtctgttgtgtacatctcttaccaaatnccttacactacgttgggtttaggtgcttgtatttt

SEQ ID NO: 42217 - DNA, 71 bp, chicken (Gallus Gallus)
  misc_feature (36): n=c or t
tcagataagtatttcagagttgttggcttgtctttngagctctgacaacaacactgaggtaacacataagc

SEQ ID NO: 42218 - DNA, 71 bp, chicken (Gallus Gallus)
  misc_feature (36): n=g or t
acagatgtatctctgtgatcagggagtataaattangactgagtgcatacaccaaagaggaatctatgcaa

SEQ ID NO: 42219 - DNA, 71 bp, chicken (Gallus Gallus)
  misc_feature (36): n=a or c
ggaattggaatgggggagaggagacaatgttttgtntttgttatgtgtttatcagctggatcatcatctta

SEQ ID NO: 42220 - DNA, 71 bp, chicken (Gallus Gallus)
  misc_feature (36): n=c or t
gcactcaaaaaattttaattattgacaaaatactanattactacttagagactgaatttaaactttaaaga

SEQ ID NO: 42221 - DNA, 71 bp, chicken (Gallus Gallus)
  misc_feature (36): n=a or g
agcagcttgcttaagcatacatttgaggcagacaanctgtcatctcacttcatgcttattcctggatctaa

SEQ ID NO: 42222 - DNA, 71 bp, chicken (Gallus Gallus)
  misc_feature (36): n=c or t
ccattgccctgccccgaaccccccgaggaaactggnaaagacgcaataccccccctggctgctgcctggca

SEQ ID NO: 42223 - DNA, 71 bp, chicken (Gallus Gallus)
  misc_feature (36): n=a or g
tgtgtaatagtagatacaggggtctgagaacaagantctggagactgcagtaccgtggttggcggaagttt

SEQ ID NO: 42224 - DNA, 71 bp, chicken (Gallus Gallus)
  misc_feature (36): n=a or c
agcagggatagataaaaacatcatggaggtttgtcntaattttgaacaagctttgcagcaaattaagaaaa

SEQ ID NO: 42225 - DNA, 71 bp, chicken (Gallus Gallus)
  misc_feature (36): n=c or t
aaaaaagctactggattctggagcattatgctacangtacatgacatcaagctacttatcacattaaacta

SEQ ID NO: 42226 - DNA, 71 bp, chicken (Gallus Gallus)
  misc_feature (36): n=c or t
agtgtctcccagctcccactagatatgtggccatantgttgtactaccccctagcacaaggaacagaatgt

SEQ ID NO: 42227 - DNA, 71 bp, chicken (Gallus Gallus)
  misc_feature (36): n=a or c
ccagctgctaaacctcttcatttccgtgcatccctngctcttcacatctgctctccagtagacccacagca

SEQ ID NO: 42228 - DNA, 71 bp, chicken (Gallus Gallus)
  misc_feature (36): n=a or g
aaactgtgtagcaaccagatgtgaacttgtgcttcngacaaaatctgagcatgccacaggcaccagagaaa

SEQ ID NO: 42229 - DNA, 71 bp, chicken (Gallus Gallus)
  misc_feature (36): n=a or g
ctgatgacaaaacataatgcacttatcatgtttccnaaagtactgactggattcagacagcatatagatta

SEQ ID NO: 42230 - DNA, 71 bp, chicken (Gallus Gallus)
  misc_feature (36): n=g or t
aaaagataaaaatgcaaattaggagtttaagttccnaagtgaacccctaaaaatatgacaagtcaatgcag

SEQ ID NO: 42231 - DNA, 71 bp, chicken (Gallus Gallus)
  misc_feature (36): n=a or g
ttcctatgcaattatctgacgtttaagaaagaaaanaaaaaaactctgtaggagaagatattgcaaagcac

SEQ ID NO: 42232 - DNA, 71 bp, chicken (Gallus Gallus)
  misc_feature (36): n=c or t
tttaagatgatttgtttctctgtctaatctgagtantgttctagaaggtgggcttgtgatctggacatttc

SEQ ID NO: 42233 - DNA, 71 bp, chicken (Gallus Gallus)
  misc_feature (36): n=a or g
tgcagggctcctcgatttaagggattccagcagcangacagccaagagcttctgcactatttgctggatgc

SEQ ID NO: 42234 - DNA, 71 bp, chicken (Gallus Gallus)
  misc_feature (36): n=c or t
aactcaatcggatgatgtcttctgcaagcaagggcncagtaaattcgagctgtttcaagcagaagaaaagc

SEQ ID NO: 42235 - DNA, 71 bp, chicken (Gallus Gallus)
  misc_feature (36): n=a or g
ttttcgaggcccaacaatggtgttccaagtctgtcncctttctgtctgaaaatggaaacgtacctaaggat

SEQ ID NO: 42236 - DNA, 71 bp, chicken (Gallus Gallus)
  misc_feature (36): n=a or g
atggtgagccactttttgtgatgctgtaagcgaggnagctcactgacctcatgaaggctctggcagttcag

SEQ ID NO: 42237 - DNA, 71 bp, chicken (Gallus Gallus)
  misc_feature (36): n=c or t
tttaaagggactaatttatatagaagaccagcaacngagggaacggttctgggcagtatctttagataatt

SEQ ID NO: 42238 - DNA, 71 bp, chicken (Gallus Gallus)
  misc_feature (36): n=c or t
gttttctagccagtcctgagtgttttcatacatttnttgtgttgggagtaactgacaacaacatactgaaa

SEQ ID NO: 42239 - DNA, 71 bp, chicken (Gallus Gallus)
  misc_feature (36): n=g or t
gccacaatgtcccaaccatcttctgtgagactgaangagaacatctgcaagcctggttgggaagccctttg

SEQ ID NO: 42240 - DNA, 71 bp, chicken (Gallus Gallus)
  misc_feature (36): n=a or g
ctacatccagtttgtgctcagagtgtcctgtttgcnaatgtgatacacctgaaagttggggagtgttattt

SEQ ID NO: 42241 - DNA, 71 bp, chicken (Gallus Gallus)
  misc_feature (36): n=a or g
ctgaaattgtggaaggatccaaataaaaaggatttnttattcatgtaaacaccctggtactagtatcaatt

SEQ ID NO: 42242 - DNA, 71 bp, chicken (Gallus Gallus)
  misc_feature (36): n=a or c
tagacttcagtctactcaacttctgcattttacatnctgcatccagaagatatttatatgattttattcct

SEQ ID NO: 42243 - DNA, 71 bp, chicken (Gallus Gallus)
  misc_feature (36): n=c or t
agaaatacatatttaccacagctcaacaactgtganttattcaggccgtggctccttcttctagcacatac

SEQ ID NO: 42244 - DNA, 71 bp, chicken (Gallus Gallus)
  misc_feature (36): n=g or t
ttttctttccacatccatctcattgctccgtggagnatatccagagatgaaaactaaaacgtaggctgaga

SEQ ID NO: 42245 - DNA, 71 bp, chicken (Gallus Gallus)
  misc_feature (36): n=a or c
ataaaccacgcacttcaggggacagattctagcctncattaaatctgctttactgagcaactccaaattga

SEQ ID NO: 42246 - DNA, 71 bp, chicken (Gallus Gallus)
  misc_feature (36): n=c or t
cattgtaggatggagctatagaaacccccagctggntgatctgctttccttccataaagcttctttttgta

SEQ ID NO: 42247 - DNA, 71 bp, chicken (Gallus Gallus)
  misc_feature (36): n=g or t
ctgtgcacgcccacacctctgtgctctgagtctttncctcagcagttacaggtggagcttgcaaaacctct

SEQ ID NO: 42248 - DNA, 71 bp, chicken (Gallus Gallus)
  misc_feature (36): n=a or g
ccatagagtaaccacaataacaacaaagttaaatantatcccagtgacagtacaattatacttgcattttt

SEQ ID NO: 42249 - DNA, 71 bp, chicken (Gallus Gallus)
  misc_feature (36): n=c or t
tccttttttaataagaaatactcccaaagaagtatngcttgactttttaatgctaatctcgcttctgtttc

SEQ ID NO: 42250 - DNA, 71 bp, chicken (Gallus Gallus)
  misc_feature (36): n=c or t
gaatttgctatatgcaggcaccaccggtaagtgggncagtatggcagggatatcatatgtaaatgagggct

SEQ ID NO: 42251 - DNA, 71 bp, chicken (Gallus Gallus)
  misc_feature (36): n=a or g
atccagttccaaccagttcaagagtaatccatcgancctctcatgtttagatagacagatgccactgcagt

SEQ ID NO: 42252 - DNA, 71 bp, chicken (Gallus Gallus)
  misc_feature (36): n=c or t
catagcaaacatgctcattttaggagaaaggataantttaaatacggaaacgaaagtggagggaagtattc

SEQ ID NO: 42253 - DNA, 71 bp, chicken (Gallus Gallus)
  misc_feature (36): n=a or g
cttccctgttaggtgtccactggttgatacctggangaaagagagttcttcttttagtgtgcagtaagtgc

SEQ ID NO: 42254 - DNA, 71 bp, chicken (Gallus Gallus)
  misc_feature (36): n=a or g
tctgtcagaatggattatgagtaaccagaaaatttnggcatttggatttgaaaagaagttatctgctgaaa

SEQ ID NO: 42255 - DNA, 71 bp, chicken (Gallus Gallus)
  misc_feature (36): n=a or g
gagcagtacaatccaaccaaacaaggggattttttnttcactttagtaaatgcatggagttgtttactcaa

SEQ ID NO: 42256 - DNA, 71 bp, chicken (Gallus Gallus)
  misc_feature (36): n=c or t
tttcagaaatgaaacttgccactcagcaagtcatcnatctaccaataaagttcaacagacctttatagaag

SEQ ID NO: 42257 - DNA, 71 bp, chicken (Gallus Gallus)
  misc_feature (36): n=g or t
aaaaacatccgtacaaaaattctgttgtagattttngacttaagaagatggttttgttttagcaatatgca

SEQ ID NO: 42258 - DNA, 71 bp, chicken (Gallus Gallus)
  misc_feature (36): n=a or g
aaccatcagttaggtcaggagatgaattctatgaangagatgagttgagttttttcagtggtataggatga

SEQ ID NO: 42259 - DNA, 71 bp, chicken (Gallus Gallus)
  misc_feature (36): n=c or t
tgtcaataagggcaataattggttggtcgacaattngtgttccagttctcattgtattctcaagaatttca

SEQ ID NO: 42260 - DNA, 71 bp, chicken (Gallus Gallus)
  misc_feature (36): n=a or c
ggatctatccaccaattgagagcactagggtgaaanaatatagcagttttaaactgaaacttgatacattt

SEQ ID NO: 42261 - DNA, 71 bp, chicken (Gallus Gallus)
  misc_feature (36): n=a or g
tccactgtcattgagtgaattcttcctattcattancaatggctgtatctcttcattgattattagaagaa

SEQ ID NO: 42262 - DNA, 71 bp, chicken (Gallus Gallus)
  misc_feature (36): n=c or t
gaataaactgtactttggttcacagaatgtaattgnggttatcattttagataacaattgctgtgattctt

SEQ ID NO: 42263 - DNA, 71 bp, chicken (Gallus Gallus)
  misc_feature (36): n=c or t
gagagctcaggagttaaattttggacatatacacanagaaaacagtgttatctgcaacttgtcttgatgat

SEQ ID NO: 42264 - DNA, 71 bp, chicken (Gallus Gallus)
  misc_feature (36): n=c or t
tcattttaaatagatgttattttctgaccaatatcntcacatttgttggtatacccatgtgccctgtttaa

SEQ ID NO: 42265 - DNA, 71 bp, chicken (Gallus Gallus)
  misc_feature (36): n=a or g
ctgaagaacttactttgtgtctaaacttagaagttnggcagtggtaatactagaatactagaattttatca

SEQ ID NO: 42266 - DNA, 71 bp, chicken (Gallus Gallus)
  misc_feature (36): n=c or t
tttccattgtatagatgcaaagatcagatgagttgnccagggtagaaacaatagtagaggtagaaacagga

SEQ ID NO: 42267 - DNA, 71 bp, chicken (Gallus Gallus)
  misc_feature (36): n=a or g
ggaaatgaggaaagaaatagattaatccgtatgacnaagttgtactgcatccatggcatcctttgcaaaat

SEQ ID NO: 42268 - DNA, 71 bp, chicken (Gallus Gallus)
  misc_feature (36): n=a or g
aggagttagatgagtatctttcagtatttgccattnaaattaataagatgctgtggcctttacattgatgt

SEQ ID NO: 42269 - DNA, 71 bp, chicken (Gallus Gallus)
  misc_feature (36): n=c or t
atatctgaaagctgtgtgcttatttcttagttatgnttttgttataaaatagtgctcacatttaatagtcc

SEQ ID NO: 42270 - DNA, 71 bp, chicken (Gallus Gallus)
  misc_feature (36): n=a or g
ctttaataaagcgggaggaggcccagaatcactgtnctcagagctgcatcagctctgtggtgtactggacc

SEQ ID NO: 42271 - DNA, 71 bp, chicken (Gallus Gallus)
  misc_feature (36): n=c or t
catgagccactgcatcgcactgggatatagactaanactcactgctctgtatcatactgaaagattgctta

SEQ ID NO: 42272 - DNA, 71 bp, chicken (Gallus Gallus)
  misc_feature (36): n=c or t
ttttttgatgactgattcatacccaatcattttgcngtaagattatatacattatatttcatatttgtcag

SEQ ID NO: 42273 - DNA, 71 bp, chicken (Gallus Gallus)
  misc_feature (36): n=a or c
agattttcatgggactggaaggtatggatctgaacncccaaccagtggctgaaggggacctagaaaacaga

SEQ ID NO: 42274 - DNA, 71 bp, chicken (Gallus Gallus)
  misc_feature (36): n=a or g
atggtactaaggcatttagcagaagggatttctttnctattgttcctctcagagaatttgaatatataatg

SEQ ID NO: 42275 - DNA, 71 bp, chicken (Gallus Gallus)
  misc_feature (36): n=c or t
accaattttttaaaaatcttctggcatttgtgccanttagcttttttataactgcactgacagattttatt

SEQ ID NO: 42276 - DNA, 71 bp, chicken (Gallus Gallus)
  misc_feature (36): n=c or t
cctgtatacattgtggcagagttatttcttcatatnttgtattttagatgctttatgcttcatttttctca

SEQ ID NO: 42277 - DNA, 71 bp, chicken (Gallus Gallus)
  misc_feature (36): n=c or t
aacgctattgcatgaattacaagttatgtgcttgcntactagtcattccctgttgtcaagtgatttgaaga

SEQ ID NO: 42278 - DNA, 71 bp, chicken (Gallus Gallus)
  misc_feature (36): n=c or t
cctcaaatcagcatgcatgttaataggctctggctnacctgtactggttaatgagagatgggtttgagggg

SEQ ID NO: 42279 - DNA, 71 bp, chicken (Gallus Gallus)
  misc_feature (36): n=a or g
gaagtctccttcatttcacaagagcatctatgcaanaagaacatcagatttttagtaaaccagtgtttaca

SEQ ID NO: 42280 - DNA, 71 bp, chicken (Gallus Gallus)
  misc_feature (36): n=a or g
ggttatgtgacaatatcacagtatgtcccccaagcnagtgataattttctatgcatcatactattctctga

SEQ ID NO: 42281 - DNA, 71 bp, chicken (Gallus Gallus)
  misc_feature (36): n=a or g
tacactctcattaagcacacattaagaaatgtaacnaaaaacgtgggataaagacagcatctatgtctagc

SEQ ID NO: 42282 - DNA, 71 bp, chicken (Gallus Gallus)
  misc_feature (36): n=a or c
ttatagcctccttcccatcccactttacttttactnccactcaggccttgtattttgttccattgaatgtt

SEQ ID NO: 42283 - DNA, 71 bp, chicken (Gallus Gallus)
  misc_feature (36): n=a or g
tagatgcagaagctttatcttcatttcttagctaanattgttcataggtattgcattgaaaattggatgtt

SEQ ID NO: 42284 - DNA, 71 bp, chicken (Gallus Gallus)
  misc_feature (36): n=g or t
tggaataaatccacttaatatttcagtgaacagtgnctcagtcttaagttaggtatatgtagcattactga

SEQ ID NO: 42285 - DNA, 71 bp, chicken (Gallus Gallus)
  misc_feature (36): n=a or g
ccatattctgctgttttatttaggaatttttgaaantttagcccagaagttaaatggcttctacataaatt

SEQ ID NO: 42286 - DNA, 71 bp, chicken (Gallus Gallus)
  misc_feature (36): n=a or g
cctctgtgaaggcaggatattcatctgccaggagancaaggtggtccagctgccccgggacattcccacca

SEQ ID NO: 42287 - DNA, 71 bp, chicken (Gallus Gallus)
  misc_feature (36): n=a or g
tctgtctttatacccctatagcaaagaatgaatganacaggtctagtctatttagtatctgatagtatctg

SEQ ID NO: 42288 - DNA, 71 bp, chicken (Gallus Gallus)
  misc_feature (36): n=c or t
ggttatcctctgctctgatctgttttcctcatcctnctctaagctcctatctgccattgtttctagggttt

SEQ ID NO: 42289 - DNA, 71 bp, chicken (Gallus Gallus)
  misc_feature (36): n=a or c
tactctgacagcagcctttcattgttcctatctctntgattgtcttttttctaggctttgcttcaataaca

SEQ ID NO: 42290 - DNA, 71 bp, chicken (Gallus Gallus)
  misc_feature (36): n=a or c
ctttctaccaatgctagcacagcttcagttagcgcntttacgagcatcaaactacaagtaagataagggtc

SEQ ID NO: 42291 - DNA, 71 bp, chicken (Gallus Gallus)
  misc_feature (36): n=a or g
catgaccttccttcacttgaataactcttacatctntgctcatttcttcctgtcggttgttatctaatttt

SEQ ID NO: 42292 - DNA, 71 bp, chicken (Gallus Gallus)
  misc_feature (36): n=c or t
aaagaatacaaaatactatcactcgctatttgtgancagaggacaaaggaaactggggatcaagagaagaa

SEQ ID NO: 42293 - DNA, 71 bp, chicken (Gallus Gallus)
  misc_feature (36): n=a or g
ttatagtcagcttgtaagatgtcttgtgaagcagtntcaaaattcctactaatatcaatatatatataatt

SEQ ID NO: 42294 - DNA, 71 bp, chicken (Gallus Gallus)
  misc_feature (36): n=a or g
tctgtatttgaagttcatatagatttaaggcaaacnaagctggacagttaaaagcttcttttgtcctagac

SEQ ID NO: 42295 - DNA, 71 bp, chicken (Gallus Gallus)
  misc_feature (36): n=a or g
ttattattcagttgctactactactttctctggatntagcaatagtaaactttgcttctgaatcagaaacc

SEQ ID NO: 42296 - DNA, 71 bp, chicken (Gallus Gallus)
  misc_feature (36): n=g or t
tagtgaaaaaattaatgttataaaatgcctaattgntttttgctttcatgtgtaagtaataaaaaatgtta

SEQ ID NO: 42297 - DNA, 71 bp, chicken (Gallus Gallus)
  misc_feature (36): n=c or t
tgcttttatcaggatattctgtacatacacaagcantgaagtacattaatataccagattttcacctgagt

SEQ ID NO: 42298 - DNA, 71 bp, chicken (Gallus Gallus)
  misc_feature (36): n=a or g
aaataatgtaatactgccttataaaaatgactttcnaattctaaatgtcagcattttttaaggaacatgaa

SEQ ID NO: 42299 - DNA, 71 bp, chicken (Gallus Gallus)
  misc_feature (36): n=g or t
agattcatgggagaagagatgacaaagtccctacanggggagagaatgcttgtaataggatacatattcct

SEQ ID NO: 42300 - DNA, 71 bp, chicken (Gallus Gallus)
  misc_feature (36): n=c or t
tacttttaattgacttactacttgcactcagtagcngctcgacacaattcatggaaaaagtgaataagaaa

SEQ ID NO: 42301 - DNA, 71 bp, chicken (Gallus Gallus)
  misc_feature (36): n=a or g
agacaatttgtttgagaaaatgagaaggcacagatngagaagcctgaaagcatccatgtcctgactggggg

SEQ ID NO: 42302 - DNA, 71 bp, chicken (Gallus Gallus)
  misc_feature (36): n=a or c
tgctgttaattgggacctcaagaaaagagcccagcngtcattctggattgagtatttgacacttgaaaaca

SEQ ID NO: 42303 - DNA, 71 bp, chicken (Gallus Gallus)
  misc_feature (36): n=a or c
tgcccaaattctctgattttctgatgcatgattgcnctattttctgggtttgaaaaatgtttcccactaac

SEQ ID NO: 42304 - DNA, 71 bp, chicken (Gallus Gallus)
  misc_feature (36): n=c or t
tttggtggggttcagtgccaaccttcaccattattnctccctgctgatggtcagatacagttgtggtggcc

SEQ ID NO: 42305 - DNA, 71 bp, chicken (Gallus Gallus)
  misc_feature (36): n=c or t
gaacaaaaaacagaggaccaaacctctcaacttacncaaatacagtgagagatgatgaaggttaaatcaca

SEQ ID NO: 42306 - DNA, 71 bp, chicken (Gallus Gallus)
  misc_feature (36): n=c or t
aagcttcgggattttccgtatccctcagggcggctnagtgctagggtggcagcgagggacagcagttatga

SEQ ID NO: 42307 - DNA, 71 bp, chicken (Gallus Gallus)
  misc_feature (36): n=g or t
atttgctctactttaccatcaggtgcttaatctatnctgcagaaggcaatccaaatcaagtattggagcag

SEQ ID NO: 42308 - DNA, 71 bp, chicken (Gallus Gallus)
  misc_feature (36): n=a or c
ttttcacatggaattgtgagtttaggtcaggaactnttatgtgcatgaacgtttatttaatccacacgttc

SEQ ID NO: 42309 - DNA, 71 bp, chicken (Gallus Gallus)
  misc_feature (36): n=a or c
tcctgctgtccccaccagctcctctatgttgactgngtggcaacagcctgcctcttgttgcttcttgctga

SEQ ID NO: 42310 - DNA, 71 bp, chicken (Gallus Gallus)
  misc_feature (36): n=c or t
agaataaggttgcaaaacacagcagatctagatctnacagggcacaccaccttcacctgcccatttgatgc

SEQ ID NO: 42311 - DNA, 71 bp, chicken (Gallus Gallus)
  misc_feature (36): n=g or t
gctgatagtacccatgcactaacattgttctccttnctgctttaatttgagctcagagccttcctaaactg

SEQ ID NO: 42312 - DNA, 71 bp, chicken (Gallus Gallus)
  misc_feature (36): n=c or t
ggagacctgtgcagctcagacagggttaatggatcnggcccagcccactaattagtcctggccttggagtg

SEQ ID NO: 42313 - DNA, 71 bp, chicken (Gallus Gallus)
  misc_feature (36): n=a or g
ttagggcaaatgcaagtacttccataatgttggctntagttattgagaatctgaaatgtcttagggagtga

SEQ ID NO: 42314 - DNA, 71 bp, chicken (Gallus Gallus)
  misc_feature (36): n=a or g
tggcacagaggaattttcaaaagcactgtcaggaanatgttttatacccactgagggaatatatgagatgg

SEQ ID NO: 42315 - DNA, 71 bp, chicken (Gallus Gallus)
  misc_feature (36): n=a or c
tggcatgactagcagagcctttaaaaagaaaccacncacgcacaaatattttatgtgcacgccttacacat

SEQ ID NO: 42316 - DNA, 71 bp, chicken (Gallus Gallus)
  misc_feature (36): n=c or t
ttgtaacaggaatgtttaatgatactgtctagatcntgaatcaaatgacaattgcatattcagctgttctg

SEQ ID NO: 42317 - DNA, 71 bp, chicken (Gallus Gallus)
  misc_feature (36): n=c or t
ttacccaaaagcttgggttaatagctacatctcaangggcacatttagcagtaagcctgttcgtgtcccag

SEQ ID NO: 42318 - DNA, 71 bp, chicken (Gallus Gallus)
  misc_feature (36): n=c or t
tctttcttggaaaactggaagacaagaatcaactgntgagcacaattgctgggctccagatttagtggtat

SEQ ID NO: 42319 - DNA, 71 bp, chicken (Gallus Gallus)
  misc_feature (36): n=a or g
ctttcctgtttagctcatggatattatcagacaaanaaagccaacttatagcttatgcaccagctctatct

SEQ ID NO: 42320 - DNA, 71 bp, chicken (Gallus Gallus)
  misc_feature (36): n=c or t
tgcaaaaccacgtctggcttgcttctaaaaagcacngatcggaagagtgttcttcccctgcagggcatggt

SEQ ID NO: 42321 - DNA, 71 bp, chicken (Gallus Gallus)
  misc_feature (36): n=a or g
cagatacttaaatcccatctcagtccctctgcctantcttggggggaattgggcagctctggtagcttctg

SEQ ID NO: 42322 - DNA, 71 bp, chicken (Gallus Gallus)
  misc_feature (36): n=c or t
tgtcatttgagcattcccctgcagggacctgaactngggtgcattgaaataacttcagtacatcaacaatg

SEQ ID NO: 42323 - DNA, 71 bp, chicken (Gallus Gallus)
  misc_feature (36): n=g or t
catatttcagtgttaggagacaaagtcaactgcaangctcttgtaacaaaccttaaagaagaaaaaaattt

SEQ ID NO: 42324 - DNA, 71 bp, chicken (Gallus Gallus)
  misc_feature (36): n=a or g
ttttgcacagtgatatcaaattgtccaaactgaccncagacagactccagacacagcagttccaacaagta

SEQ ID NO: 42325 - DNA, 71 bp, chicken (Gallus Gallus)
  misc_feature (36): n=a or c
ggaattctaatgttctgtgtttaatccattagcagnagaagataactgcctctttattaaaacctagcaat

SEQ ID NO: 42326 - DNA, 71 bp, chicken (Gallus Gallus)
  misc_feature (36): n=a or c
ctgtggggactgctggatggtataggcatgattccncccatctgcctctttccacctcccagaagctctga

SEQ ID NO: 42327 - DNA, 71 bp, chicken (Gallus Gallus)
  misc_feature (36): n=g or t
attgccaaattagtactcccaaactaagtgcatgcnagagaagtagtgctttaatagtttcttcagaagta

SEQ ID NO: 42328 - DNA, 71 bp, chicken (Gallus Gallus)
  misc_feature (36): n=a or g
aaatcattgacaatgcaaacatttgtctcttctgcnagtaattgttccacattgttctaggatggtgaagt

SEQ ID NO: 42329 - DNA, 71 bp, chicken (Gallus Gallus)
  misc_feature (36): n=a or g
ttgtctatttctttctgaaagttgagaagcatggangagctgtctaaggagaagaggtggatccatcatac

SEQ ID NO: 42330 - DNA, 71 bp, chicken (Gallus Gallus)
  misc_feature (36): n=c or t
tgtaggtaacagctatgcttaggaagagtccaggangcagaacaaatagaaaagagtctctgcagcattct

SEQ ID NO: 42331 - DNA, 71 bp, chicken (Gallus Gallus)
  misc_feature (36): n=a or g
tacaaaaccatattgcagtgcactcacaggcaactnatggatttgggggaaatggcgatactgtgcatgct

SEQ ID NO: 42332 - DNA, 71 bp, chicken (Gallus Gallus)
  misc_feature (36): n=c or t
ggaacgattcagagcactaacacaaacaacacaacntaagctatttctgcaaatggtcctgaaaggttttc

SEQ ID NO: 42333 - DNA, 71 bp, chicken (Gallus Gallus)
  misc_feature (36): n=a or g
tcaggcccttcttggagacaccaaggagttaggatngtgaaggtacttaattacatgatgataattggctt

SEQ ID NO: 42334 - DNA, 71 bp, chicken (Gallus Gallus)
  misc_feature (36): n=a or g
tccccagttactccagctcaaacaagcttattacancctaactttgatgcagcttttggaacaacagctcc

SEQ ID NO: 42335 - DNA, 71 bp, chicken (Gallus Gallus)
  misc_feature (36): n=c or t
aacactgccaccacctaccctcagcccgaggacctngaagccttcatccgttcgcagatgtacagcactga

SEQ ID NO: 42336 - DNA, 71 bp, chicken (Gallus Gallus)
  misc_feature (36): n=c or t
caccatagtgactctttttaaatacctatttaccgnttttgcctgatgctggcctgagactactctaatga

SEQ ID NO: 42337 - DNA, 71 bp, chicken (Gallus Gallus)
  misc_feature (36): n=a or g
tcagtaagctcagacaagtgcaaagtgtgaagatgnctcgtcaatgcagaaatcattctgagcaacagctg

SEQ ID NO: 42338 - DNA, 71 bp, chicken (Gallus Gallus)
  misc_feature (36): n=g or t
cccctaaaactgttgtaataaagaaaaaggcttaantgttgtcagttctttcatctcatctactttcattc

SEQ ID NO: 42339 - DNA, 71 bp, chicken (Gallus Gallus)
  misc_feature (36): n=c or t
tcaaggcaacatgattattaatctgaaagacaatcnaaatgcatacaaataaattctactgtacaaagttc

SEQ ID NO: 42340 - DNA, 71 bp, chicken (Gallus Gallus)
  misc_feature (36): n=c or t
tgctggggtggggaccactctttgttcctccgcacngtggcctgtgttggcacatgggtggacgaggacac

SEQ ID NO: 42341 - DNA, 71 bp, chicken (Gallus Gallus)
  misc_feature (36): n=a or g
agttcatctttttgctgtacagtctcagagccccanaatattgatatacaataaatgctaccaagctaatt

SEQ ID NO: 42342 - DNA, 71 bp, chicken (Gallus Gallus)
  misc_feature (36): n=c or t
taatttttgtttagcttaggacatcatctcttcttngcttgtctgtgcatccaggctgcaacttttccttt

SEQ ID NO: 42343 - DNA, 71 bp, chicken (Gallus Gallus)
  misc_feature (36): n=a or c
ctgagcggcaattagtcctgttctttcttcaccatncagctgaagctcccgggaattgcagaggctttcag

SEQ ID NO: 42344 - DNA, 71 bp, chicken (Gallus Gallus)
  misc_feature (36): n=c or t
gtctacacttatttaatatctttgccttttcagtangactttctgcatgtagctctatgagcccatagttc

SEQ ID NO: 42345 - DNA, 71 bp, chicken (Gallus Gallus)
  misc_feature (36): n=c or t
ttatcctcaaattaacccctcttctcccagcccccntccttaatatcatccaaaaggctgacagggttgat

SEQ ID NO: 42346 - DNA, 71 bp, chicken (Gallus Gallus)
  misc_feature (36): n=a or g
ttcagacgtctttgatcacctaatgtggcaacaggnaagtggggccaatggatgaagacttggaggactgt

SEQ ID NO: 42347 - DNA, 71 bp, chicken (Gallus Gallus)
  misc_feature (36): n=a or g
tgtagcttgatgaaatatgacagtgtgatttcttcnacttcttgattaaaatgttcaaaaaacccttttat

SEQ ID NO: 42348 - DNA, 71 bp, chicken (Gallus Gallus)
  misc_feature (36): n=a or g
tagattctgtgagatactctgagaagtcttgtctantgaattgaatagactttgaatcttatttgcttagt

SEQ ID NO: 42349 - DNA, 71 bp, chicken (Gallus Gallus)
  misc_feature (36): n=g or t
agaaatcataatcaattactcttgaaaaacaatatngggtaggcaacctgaatactcagcatggagcaagg

SEQ ID NO: 42350 - DNA, 71 bp, chicken (Gallus Gallus)
  misc_feature (36): n=a or g
acttcattttatatgacctgcaggcctataatgtcntagtaacccatgaaaggtaagctgatacctattat

SEQ ID NO: 42351 - DNA, 71 bp, chicken (Gallus Gallus)
  misc_feature (36): n=a or g
acatggctagttcaccacaatgtccttctcacactngtgtgaactgactgccccaaaggacaggaataggg

SEQ ID NO: 42352 - DNA, 71 bp, chicken (Gallus Gallus)
  misc_feature (36): n=a or c
attctggcacatgctctctgataagcttattgcaantgcagcagttatccatggacaggcaatagcaagaa

SEQ ID NO: 42353 - DNA, 71 bp, chicken (Gallus Gallus)
  misc_feature (36): n=a or c
aacaaaggtgatgtttgggaccatctaagaggaatnttgaagcgttagcaaggcatctactcatgcacggt

SEQ ID NO: 42354 - DNA, 71 bp, chicken (Gallus Gallus)
  misc_feature (36): n=a or c
caaatggattaatacttctcttagtaacccctgaantctcaaagggtttagcagtgaaagagtgcattata

SEQ ID NO: 42355 - DNA, 71 bp, chicken (Gallus Gallus)
  misc_feature (36): n=a or g
atgagaatgattaatgataacaaaaactctagaaancaaacacatatccataccaaatgatcctttaatgc

SEQ ID NO: 42356 - DNA, 71 bp, chicken (Gallus Gallus)
  misc_feature (36): n=a or c
aggaagataattaataagaccaggaaagtagacaanagaacaccatgtaatgtgtaattaagaagacctca

SEQ ID NO: 42357 - DNA, 71 bp, chicken (Gallus Gallus)
  misc_feature (36): n=c or t
agtgtagagtgaatgatttgcatctcaatattatcnttgattaaaaaaagttgagcaatcctaaactgcgt

SEQ ID NO: 42358 - DNA, 71 bp, chicken (Gallus Gallus)
  misc_feature (36): n=a or c
gcattcagactggtctcctcatgaaggtagattgcnaaatcctttcttgctttctagaataatttcttact

SEQ ID NO: 42359 - DNA, 71 bp, chicken (Gallus Gallus)
  misc_feature (36): n=a or g
ttccctgtttgcataaatcagagaaagtcattgaanctgtaatgatttacacaagcatatttttttaaccc

SEQ ID NO: 42360 - DNA, 71 bp, chicken (Gallus Gallus)
  misc_feature (36): n=a or g
tcttgctataccatctgtagttttaaaacctcggtntactcttctaaaagaagtactcaatggagtataca

SEQ ID NO: 42361 - DNA, 71 bp, chicken (Gallus Gallus)
  misc_feature (36): n=a or c
cctacgtgtgttgcaaatgtatctttaactcatcanacataacctactatgtgctcctgtgaacagagcaa

SEQ ID NO: 42362 - DNA, 71 bp, chicken (Gallus Gallus)
  misc_feature (36): n=a or g
taaagaaattgtgtcaatttggaaatcttacatccncatgaaagtatttttagataccattgctatgagtc

SEQ ID NO: 42363 - DNA, 71 bp, chicken (Gallus Gallus)
  misc_feature (36): n=c or t
cctcagtggccctgagcagcccgccatttgacaacncacaggcatgacaatttgggggcagcttgctcagt

SEQ ID NO: 42364 - DNA, 71 bp, chicken (Gallus Gallus)
  misc_feature (36): n=c or t
tgtgcagtgaagctgctggattcacgctatacattngaacaaaagaattctgcgtattctctgttgatttg

SEQ ID NO: 42365 - DNA, 71 bp, chicken (Gallus Gallus)
  misc_feature (36): n=a or c
tcatcattcttacaatcctttcctggatcatctccngtttacagtgtcctacacccatccagaactagcat

SEQ ID NO: 42366 - DNA, 71 bp, chicken (Gallus Gallus)
  misc_feature (36): n=c or t
cagtacagtcagacaggagtaagttagaactagctnggatgtctcttcatctcgttgtatccacatttacc

SEQ ID NO: 42367 - DNA, 71 bp, chicken (Gallus Gallus)
  misc_feature (36): n=a or g
tcatattttcgaagtccattcttttcagcaaagtcnttactgcgagctttggtattggctggaggagacaa

SEQ ID NO: 42368 - DNA, 71 bp, chicken (Gallus Gallus)
  misc_feature (36): n=c or t
gcatctctttaaatgtattatcatttcccttctttntctttttcttgtctaatttaagatgttttcagaac

SEQ ID NO: 42369 - DNA, 71 bp, chicken (Gallus Gallus)
  misc_feature (36): n=g or t
gaacttatcttgggcataatgtagactatgagcacngccatcagtggctggctgattaattaaaaaaccct

SEQ ID NO: 42370 - DNA, 71 bp, chicken (Gallus Gallus)
  misc_feature (36): n=g or t
ttttctgagaaactcagactatgaagtattaggatnttatagcagtggtattcattttgatccctatttcc

SEQ ID NO: 42371 - DNA, 71 bp, chicken (Gallus Gallus)
  misc_feature (36): n=a or c
agagagttaggaagaaggtggtggaaatcccaaacnttccgttttcactcattacagaaaaatacatcaaa

SEQ ID NO: 42372 - DNA, 71 bp, chicken (Gallus Gallus)
  misc_feature (36): n=c or t
cacatgcaagtacataaacactactcagatgtgtancagatttaatgtaaaagtctaattcttttcctagg

SEQ ID NO: 42373 - DNA, 71 bp, chicken (Gallus Gallus)
  misc_feature (36): n=a or g
ttccaatacctaaccactcccattcacatcaaactntctatcaagtcacatgttggtattattatagcatt

SEQ ID NO: 42374 - DNA, 71 bp, chicken (Gallus Gallus)
  misc_feature (36): n=a or g
actatcaaacactttaaaggcagaaggaaggtaacnggacagtagttactgaccaggagtttctgaatgtt

SEQ ID NO: 42375 - DNA, 71 bp, chicken (Gallus Gallus)
  misc_feature (36): n=c or t
ttcaggttgaagaaacttcttgagcaggagaagatntatcaagctcggaaggagaaagaacacacaaagag

SEQ ID NO: 42376 - DNA, 71 bp, chicken (Gallus Gallus)
  misc_feature (36): n=a or c
ctttcctgaaataaaggttttctttgacaatcctgnatgagataattcatttggatatgtgactgactcag

SEQ ID NO: 42377 - DNA, 71 bp, chicken (Gallus Gallus)
  misc_feature (36): n=a or g
ctaagagaggatttgggttcaagtttacagatagcngaggcacacatatgggttcctaacacagcccccat

SEQ ID NO: 42378 - DNA, 71 bp, chicken (Gallus Gallus)
  misc_feature (36): n=c or t
gaaaatgaaataaggtatttatcttacccttaatgnatctcattttatgctttcagaatatggagtaatag

SEQ ID NO: 42379 - DNA, 71 bp, chicken (Gallus Gallus)
  misc_feature (36): n=a or g
gttgctgtgaacccgttacacagcacttgtcacagnacaagcacttcctgttgtgtacagcagcattcaat

SEQ ID NO: 42380 - DNA, 71 bp, chicken (Gallus Gallus)
  misc_feature (36): n=g or t
aaggttgcaatcactttcacagaagtcacaagcggntatgctttgcattacttccgaattgtagcttctca

SEQ ID NO: 42381 - DNA, 71 bp, chicken (Gallus Gallus)
  misc_feature (36): n=a or g
aagctccttttaaaaactggaagaattcattcaatntgaacacctgctgttgaaaaatacagtcatgtggt

SEQ ID NO: 42382 - DNA, 71 bp, chicken (Gallus Gallus)
  misc_feature (36): n=c or t
aatgttaatctctcaagagatttctcccattgtttncctccttatttctgataacacctctctccccagtt

SEQ ID NO: 42383 - DNA, 71 bp, chicken (Gallus Gallus)
  misc_feature (36): n=a or c
ttaatttccagatgactaaaaatgctgaacatgaanatgaataggaaaatgctgaacaatcttcacttctt

SEQ ID NO: 42384 - DNA, 71 bp, chicken (Gallus Gallus)
  misc_feature (36): n=c or t
taacaggtaaagggaagcatagattttcagtaatgntgtgcacttaagtacattaaaaatttaaatgtatt

SEQ ID NO: 42385 - DNA, 71 bp, chicken (Gallus Gallus)
  misc_feature (36): n=a or g
aaggtaggaggatggcccctctgtgtcacctggaanagatgagttccttgtgctttctgagccttccagag

SEQ ID NO: 42386 - DNA, 71 bp, chicken (Gallus Gallus)
  misc_feature (36): n=g or t
agttcaagccattctaggattctataatctccaccntgacccaatgcacccctgggaatcataactgtaga

SEQ ID NO: 42387 - DNA, 71 bp, chicken (Gallus Gallus)
  misc_feature (36): n=c or t
gccagctggatctgaaatagctgctaccacatgtanggtcatttaagatgctgcttccagaattgcttttg

SEQ ID NO: 42388 - DNA, 71 bp, chicken (Gallus Gallus)
  misc_feature (36): n=c or t
catctcagggctcaaagcatttcccaagggttggancacttcatgttatcaccacagagcccaaacactct

SEQ ID NO: 42389 - DNA, 71 bp, chicken (Gallus Gallus)
  misc_feature (36): n=c or t
attcttttcaccataaattagatcaaaaatcacagnctgaatgaagcctatgcactggtaggttgctaggg

SEQ ID NO: 42390 - DNA, 71 bp, chicken (Gallus Gallus)
  misc_feature (36): n=a or g
ctgcaaagtacagcagcccctacacaggaaaggctntcactggcagttcactaccacaattgcaaagctag

SEQ ID NO: 42391 - DNA, 71 bp, chicken (Gallus Gallus)
  misc_feature (36): n=a or c
aactacactcagagagaaccactttcagtatcaggnaggaaaaagtgaaaaccagaagtcaatcttttcca

SEQ ID NO: 42392 - DNA, 71 bp, chicken (Gallus Gallus)
  misc_feature (36): n=a or c
aaaccttgctcctgatataatgcattttgctacctngccttttattaaagagttcaatctgaagctttcaa

SEQ ID NO: 42393 - DNA, 71 bp, chicken (Gallus Gallus)
  misc_feature (36): n=a or g
tgtagatccattattcttttctttccacgaacttangagtttcacagagcttctgctgcatacataattca

SEQ ID NO: 42394 - DNA, 71 bp, chicken (Gallus Gallus)
  misc_feature (36): n=c or t
gatctagatcagagagcctgcaggaggggaaaacanacagctgctgacttgcaaagaggctagagagagct

SEQ ID NO: 42395 - DNA, 71 bp, chicken (Gallus Gallus)
  misc_feature (36): n=a or g
gagtgtcacaggaaagtatgtgtacaatgatcacanaaagtggagtgctgtagggatacgcagaagtgaat

SEQ ID NO: 42396 - DNA, 71 bp, chicken (Gallus Gallus)
  misc_feature (36): n=a or c
tttctactgttatcatcttgctaaatcgatatgatnaaaatgttgggaaggaaaagtatactgcaatcacg

SEQ ID NO: 42397 - DNA, 71 bp, chicken (Gallus Gallus)
  misc_feature (36): n=c or t
aagaattgctgtgcagttgaacacttcagcttttcngtattgtcacctcgttgttctgagttttactatgt

SEQ ID NO: 42398 - DNA, 71 bp, chicken (Gallus Gallus)
  misc_feature (36): n=c or t
tattttaaattcagactctaaacattttcttatttncacttaatagtaattgctgaaattactgttcccat

SEQ ID NO: 42399 - DNA, 71 bp, chicken (Gallus Gallus)
  misc_feature (36): n=g or t
atttatggtagctcctttctagaaactttctctggngtatttcaggacatatagaaatgcgcgtgcatttt

SEQ ID NO: 42400 - DNA, 71 bp, chicken (Gallus Gallus)
  misc_feature (36): n=g or t
atctcttctgttttagaagagcaagcattagagctnttaaatgtgttctttatttgagtgtgaagaccaga

SEQ ID NO: 42401 - DNA, 71 bp, chicken (Gallus Gallus)
  misc_feature (36): n=g or t
gagtaatagctttttatctcttatgttgagaataanatgatgagggcacacttactgcaggacttccatgt

SEQ ID NO: 42402 - DNA, 71 bp, chicken (Gallus Gallus)
  misc_feature (36): n=a or g
gaatacctaggatggaacagggaatatcattagganagtagaaaacatggcccaaccagcatggccatgtg

SEQ ID NO: 42403 - DNA, 71 bp, chicken (Gallus Gallus)
  misc_feature (36): n=a or g
tcagtggtcaccacagacttgtgactgtataaatcnaggaaagccagtagtgtagctaacaaaaatgattg

SEQ ID NO: 42404 - DNA, 71 bp, chicken (Gallus Gallus)
  misc_feature (36): n=g or t
ttttcatctgagttcatgaaataactcctgtatttntgccaattactttggagggattctggctttcagtt

SEQ ID NO: 42405 - DNA, 71 bp, chicken (Gallus Gallus)
  misc_feature (36): n=a or g
aggtatgaattctgaaagtccatcattcccattccnacaatgtgtataaaatcttcaatcacctgcattaa

SEQ ID NO: 42406 - DNA, 71 bp, chicken (Gallus Gallus)
  misc_feature (36): n=a or g
acattttcgacactacagtgtacgtgcatgtccacngacaggcaatgaggtatgcaggcatgaaaaaaaag

SEQ ID NO: 42407 - DNA, 71 bp, chicken (Gallus Gallus)
  misc_feature (36): n=c or t
gatcaaaactatttgcttcatagctacattttcttngatgagctctactgatcacaaattcccttgtttag

SEQ ID NO: 42408 - DNA, 71 bp, chicken (Gallus Gallus)
  misc_feature (36): n=c or t
agagaactgcatcaaactttttccctcttccagccncttgctttcaacattagcccaacatttctttcagc

SEQ ID NO: 42409 - DNA, 71 bp, chicken (Gallus Gallus)
  misc_feature (36): n=c or t
gattactgacttcctaaaccttcctctacaaacatntaataataccgtagcaattttattacgttttttct

SEQ ID NO: 42410 - DNA, 71 bp, chicken (Gallus Gallus)
  misc_feature (36): n=c or t
tttgcccagatgtcactgtttgggtgttttcattgngtttagaaaatatgggaatatctatgtgaggaaaa

SEQ ID NO: 42411 - DNA, 71 bp, chicken (Gallus Gallus)
  misc_feature (36): n=a or g
tatccagagattaagggaacaatgctgcttccccanagaaagatgaagcagactgacagacttgcattttg

SEQ ID NO: 42412 - DNA, 71 bp, chicken (Gallus Gallus)
  misc_feature (36): n=c or t
attcactgatttttgttggatattaaattcataccnatagatttagacagctgtgtcttgcacatattgct

SEQ ID NO: 42413 - DNA, 71 bp, chicken (Gallus Gallus)
  misc_feature (36): n=c or t
agtatgacaagtaaaggtttataatcctcgtaatcnttgaaaatcaattcagtgcttgtgaagtacagttt

SEQ ID NO: 42414 - DNA, 71 bp, chicken (Gallus Gallus)
  misc_feature (36): n=a or g
gcactgcttttgtgtttgttgcttcgtatatgtgtntattcaactattactgaattagggctgtacctaaa

SEQ ID NO: 42415 - DNA, 71 bp, chicken (Gallus Gallus)
  misc_feature (36): n=g or t
cagatcaataagctgcattgcaaatttcaccgcggnttcaacatcacctgcaaggcaattgttttgaaaca

SEQ ID NO: 42416 - DNA, 71 bp, chicken (Gallus Gallus)
  misc_feature (36): n=c or t
attttgttaacgtacgtaccacagtctgaaggcatnggtgctgcagcaacagaaaaagtaactgatgtttc

SEQ ID NO: 42417 - DNA, 71 bp, chicken (Gallus Gallus)
  misc_feature (36): n=g or t
agtaggggaaggaaaatatggaagctgaaagcactntaataaaaacaggaagtgaaaagctatggaagggt

SEQ ID NO: 42418 - DNA, 71 bp, chicken (Gallus Gallus)
  misc_feature (36): n=g or t
ttggaaatctcactagtcagccaggacgctcaaatnacgtgcaggtacgctgattgcctataaatgttctc

SEQ ID NO: 42419 - DNA, 71 bp, chicken (Gallus Gallus)
  misc_feature (36): n=c or t
aacttgcagaaatcttctgtcttggctgaatttctncagttatttcttattagaggtcatagcaaaccctt

SEQ ID NO: 42420 - DNA, 71 bp, chicken (Gallus Gallus)
  misc_feature (36): n=a or g
ggagagtttagaaaaacctgacccctagtcataccntgccactaatgctgcagctccaagcttgtggaacc

SEQ ID NO: 42421 - DNA, 71 bp, chicken (Gallus Gallus)
  misc_feature (36): n=c or t
aaataaaatattttccaggagcgaaatcaatgtaanataaaacatcttgttttggaacacagtctggatgc

SEQ ID NO: 42422 - DNA, 71 bp, chicken (Gallus Gallus)
  misc_feature (36): n=a or c
gcctcagagcttttatgcatcaagacttgttgcagnacaaagtcattctttttggcctatcactgggtatg

SEQ ID NO: 42423 - DNA, 71 bp, chicken (Gallus Gallus)
  misc_feature (36): n=c or t
tgagaacactaatatttgaccagtcttctgtttatnttccctctgaaattaagattgtcctgatccctaac

SEQ ID NO: 42424 - DNA, 71 bp, chicken (Gallus Gallus)
  misc_feature (36): n=c or t
ttgttatagtttaatttgccattaaggatactccantctccattaatctataacaatgtacttgagatatt

SEQ ID NO: 42425 - DNA, 71 bp, chicken (Gallus Gallus)
  misc_feature (36): n=a or g
agtgctataaaaacacttgtagtgattgatgcaggnaagagggtttcagtaggagaggaggaaaaaaaccc

SEQ ID NO: 42426 - DNA, 71 bp, chicken (Gallus Gallus)
  misc_feature (36): n=a or c
atcaaaacagttttgctgagtattttggtctctcanagagtattttcttttattgtggaataatccccaat

SEQ ID NO: 42427 - DNA, 71 bp, chicken (Gallus Gallus)
  misc_feature (36): n=a or g
gcttaaggagttattccaaagtagaattgatgtgcncagctacagaaatgtgtaaggattatcctacatcc

SEQ ID NO: 42428 - DNA, 71 bp, chicken (Gallus Gallus)
  misc_feature (36): n=c or t
tgagcaccatggttccataaaagctagcaaaagaanttgagtatttttgtgacaatataggtgaatcattg

SEQ ID NO: 42429 - DNA, 71 bp, chicken (Gallus Gallus)
  misc_feature (36): n=a or c
aaaataacattttctagagagtgacttaattatctnttcttgcagctatgctgtaggtatttgagaaatat

SEQ ID NO: 42430 - DNA, 71 bp, chicken (Gallus Gallus)
  misc_feature (36): n=a or c
ttctgtgtgttcctccctgttaactctgacagctgntataaactgtgctagaacaaaccctggagaaccca

SEQ ID NO: 42431 - DNA, 71 bp, chicken (Gallus Gallus)
  misc_feature (36): n=a or g
attaatggctgcagaatccacgctgtatgcagaagngattcataccattataaatgctctgtgctaatctg

SEQ ID NO: 42432 - DNA, 71 bp, chicken (Gallus Gallus)
  misc_feature (36): n=a or g
aggtttttgtgctggtgtggaaagtattaagcactnagagaaaagcaagaacactgggtttgcaaaggcac

SEQ ID NO: 42433 - DNA, 71 bp, chicken (Gallus Gallus)
  misc_feature (36): n=a or g
ctccaccttcgctgttctgatttttgtgacctcccntgagtgctgacaaagggtaagaaggatgaaggtgt

SEQ ID NO: 42434 - DNA, 71 bp, chicken (Gallus Gallus)
  misc_feature (36): n=a or g
ctcctggcatccctcaactacttttgtggaaggagnaaaaaaaaggcgaaaaatgatgtctacatatgtag

SEQ ID NO: 42435 - DNA, 71 bp, chicken (Gallus Gallus)
  misc_feature (36): n=c or t
ggtgatacagggtttccaggaatgcctgggcgatcngtaagttctacccagacaatgtgatgtgcctttac

SEQ ID NO: 42436 - DNA, 71 bp, chicken (Gallus Gallus)
  misc_feature (36): n=a or g
tgtcagggatattattgtcacctagaagaggaaaancacacaggacctgcacaacttctcttgctttatgt

SEQ ID NO: 42437 - DNA, 71 bp, chicken (Gallus Gallus)
  misc_feature (36): n=a or g
acactttggtaaacacagcagctctagaaatcaggncctttagaatgcagtactacaggtctgatgaatgg

SEQ ID NO: 42438 - DNA, 71 bp, chicken (Gallus Gallus)
  misc_feature (36): n=g or t
tcgctaagaaggaaatttttcataaggcaatgaacncaaagtttgatttgattgatttgcatgcaatagat

SEQ ID NO: 42439 - DNA, 71 bp, chicken (Gallus Gallus)
  misc_feature (36): n=g or t
tagtcttagcctaacataacttctagacaaccagcnttcacatatctaggagagcagggatgaattccatc

SEQ ID NO: 42440 - DNA, 71 bp, chicken (Gallus Gallus)
  misc_feature (36): n=g or t
cctcttgctcatgtgtcaatgcaatataaaatctangcaataaatgtgttaaactgtacctttaaatgagc

SEQ ID NO: 42441 - DNA, 71 bp, chicken (Gallus Gallus)
  misc_feature (36): n=c or t
aacgtgtttacactctttgtttgaagatcatttaangtcacttttttctccatcttttacaggtaaacaga

SEQ ID NO: 42442 - DNA, 71 bp, chicken (Gallus Gallus)
  misc_feature (36): n=c or t
attgaacctcacctgcgctgtgcacgaaaggactgnggccctctgaagcacttggttctaagggtttcctt

SEQ ID NO: 42443 - DNA, 71 bp, chicken (Gallus Gallus)
  misc_feature (36): n=a or c
tgtgcttcagagtaaaattttagtacgttgttatanaaaaagaggaagattcaaaacatgcaggtagaaag

SEQ ID NO: 42444 - DNA, 71 bp, chicken (Gallus Gallus)
  misc_feature (36): n=c or t
tagagataatattggttgaaatgaatcttttacctnaccggaaaatcgtgtgctcctatccttaacatggt

SEQ ID NO: 42445 - DNA, 71 bp, chicken (Gallus Gallus)
  misc_feature (36): n=a or g
attttttcaagacaactcacatgacagaacatgagnctgggaatctcctggggaaactcactgtttgacat

SEQ ID NO: 42446 - DNA, 71 bp, chicken (Gallus Gallus)
  misc_feature (36): n=g or t
ctgtattcatgcctgccatagggaaaattcccactnatttcactgagagtttccaggaagaaatgagtact

SEQ ID NO: 42447 - DNA, 71 bp, chicken (Gallus Gallus)
  misc_feature (36): n=a or g
tttatttaaatgataattgagaagatgcaaaatatngttctcttaaatctagttcctgggaatgagcaaat

SEQ ID NO: 42448 - DNA, 71 bp, chicken (Gallus Gallus)
  misc_feature (36): n=a or g
aagctcaccttcagcaccgtaaagaattacataatnaacaacagtcttcaataatgctacaccctgcacta

SEQ ID NO: 42449 - DNA, 71 bp, chicken (Gallus Gallus)
  misc_feature (36): n=a or g
cacaggaacaaagatgtggtgctaacatacagatgncagagttcaaagccttccagcgcctgtgtagccct

SEQ ID NO: 42450 - DNA, 71 bp, chicken (Gallus Gallus)
  misc_feature (36): n=c or t
tgaataattatatatacacttccatgtgttcctagntcaaaaaacagagttggtcttcagtctgtatctgg

SEQ ID NO: 42451 - DNA, 71 bp, chicken (Gallus Gallus)
  misc_feature (36): n=a or g
actgaatttcaagcatggatcttctcattatgtacntgaagagttggctgccaagagatcaacttctgttc

SEQ ID NO: 42452 - DNA, 71 bp, chicken (Gallus Gallus)
  misc_feature (36): n=c or t
accaaaatgagcaacatgcctacaattaagaagttnctgcagcctggcagcccaaggaagcccccaccaga

SEQ ID NO: 42453 - DNA, 71 bp, chicken (Gallus Gallus)
  misc_feature (36): n=a or g
gtaaaaaaatccaagtcatctgattcttaagctatnaaggatgggattataattgccttgctttcattggc

SEQ ID NO: 42454 - DNA, 71 bp, chicken (Gallus Gallus)
  misc_feature (36): n=a or g
atagtcaagtgaaaaatagcagccccttcacatcantgtcagaagagcctcatgatagataccctaaagcc

SEQ ID NO: 42455 - DNA, 71 bp, chicken (Gallus Gallus)
  misc_feature (36): n=a or g
cttttgtcttctaaaaaattcccatcgctgccaaanctggtgaagctactctggtggttacgatggtggga

SEQ ID NO: 42456 - DNA, 71 bp, chicken (Gallus Gallus)
  misc_feature (36): n=c or t
catgaaaatgacttgattttcccccgtgttctcctngagacatcctagagatgtttcagttttccttagtt

SEQ ID NO: 42457 - DNA, 71 bp, chicken (Gallus Gallus)
  misc_feature (36): n=a or g
tctaatgtagtgtggtattcttttcttctgtctctntgtatagacctaccaggagtgtgagtacagtaatt

SEQ ID NO: 42458 - DNA, 71 bp, chicken (Gallus Gallus)
  misc_feature (36): n=c or t
gttccatatgaagtagttgcaattacctgtgtctangtgcaaataataaaaagagaacgatgttaaaatga

SEQ ID NO: 42459 - DNA, 71 bp, chicken (Gallus Gallus)
  misc_feature (36): n=c or t
gatcattgtcataattagctctaaagaaattgttanttatgtatgatggaaagttgtttgcatagagtcat

SEQ ID NO: 42460 - DNA, 71 bp, chicken (Gallus Gallus)
  misc_feature (36): n=a or c
gtgcttccaatttatgtactgattagttaccatagnatcgtggagacagataatttaaatactgttgatgt

SEQ ID NO: 42461 - DNA, 71 bp, chicken (Gallus Gallus)
  misc_feature (36): n=c or t
caagcttggttttggtgtccaaggctccaaagaacntctctttcaaagtgtcacttcactgtggcacaatc

SEQ ID NO: 42462 - DNA, 71 bp, chicken (Gallus Gallus)
  misc_feature (36): n=a or g
actactctggctttttagaactgagacaaaccccanatcttaattggtctctatagggaaactggtgttta

SEQ ID NO: 42463 - DNA, 71 bp, chicken (Gallus Gallus)
  misc_feature (36): n=a or g
tttctaccttagaaatgtgggttacagagttggaanttatttttcatccactgaacttcatgaatttctac

SEQ ID NO: 42464 - DNA, 71 bp, chicken (Gallus Gallus)
  misc_feature (36): n=a or c
gagacagtggctatgcatcacaaccttgtgtagatncctctgagaaaagtcagcctagcaacaaagcactc

SEQ ID NO: 42465 - DNA, 71 bp, chicken (Gallus Gallus)
  misc_feature (36): n=c or t
gcctgcactctgccttcttgctgccctggacatacnctaactgtcaacagcacagtgtggcaacataatgt

SEQ ID NO: 42466 - DNA, 71 bp, chicken (Gallus Gallus)
  misc_feature (36): n=g or t
tagcgtttggatcagttttgtctcttgataagtacnatatgaatccagacatactgctttactagttacag

SEQ ID NO: 42467 - DNA, 71 bp, chicken (Gallus Gallus)
  misc_feature (36): n=a or c
ttactagagttaaaatatcttgagaaaattgttctnccattgttaggaatcaaagttgatataaacctcag

SEQ ID NO: 42468 - DNA, 71 bp, chicken (Gallus Gallus)
  misc_feature (36): n=a or g
gtcctgaagttaatagtcaaatgcaaagctatatantttagttctcttcctccatttcattacctggaaat

SEQ ID NO: 42469 - DNA, 71 bp, chicken (Gallus Gallus)
  misc_feature (36): n=a or g
tccatcttatttcacgatattttactaatccatttntgaatttaaaattgcttactgtatctgaaggcatt

SEQ ID NO: 42470 - DNA, 71 bp, chicken (Gallus Gallus)
  misc_feature (36): n=c or t
tcctgtaactggttggtcagcaaaccatataaacantgcatatagatctaaatctgtagtcttgttcaggt

SEQ ID NO: 42471 - DNA, 71 bp, chicken (Gallus Gallus)
  misc_feature (36): n=g or t
ttgttgttgattgcttggaagtaactccatggaagnacagttgggaaagcaggagatcctttgttgccaga

SEQ ID NO: 42472 - DNA, 71 bp, chicken (Gallus Gallus)
  misc_feature (36): n=a or g
gcttcaatgagtaaccactttctttttacacctccnaattgtcatcgatcaattcttctacgatgggaagg

SEQ ID NO: 42473 - DNA, 71 bp, chicken (Gallus Gallus)
  misc_feature (36): n=a or g
ctgaagtccgtgttccagcgcctgattataaagtcncatcacccaagaaaggcgtttttgtctggcacgga

SEQ ID NO: 42474 - DNA, 71 bp, chicken (Gallus Gallus)
  misc_feature (36): n=a or g
cttattatttaaatattttaaggaatatatctccantatgcaaaaatgtacttttgcattgtctttgtatc

SEQ ID NO: 42475 - DNA, 71 bp, chicken (Gallus Gallus)
  misc_feature (36): n=a or g
ttttgcatgtcttctgagacaacatgatcatcaaantacctctcccttgacaaagttcacattcctacagt

SEQ ID NO: 42476 - DNA, 71 bp, chicken (Gallus Gallus)
  misc_feature (36): n=c or t
tatttgacccatagatccagtaactgatacagctgntcatgttcagttgattttgcttatgtgtttcctgt

SEQ ID NO: 42477 - DNA, 71 bp, chicken (Gallus Gallus)
  misc_feature (36): n=c or t
gtgtttttttccagtctccttagcacccagtgttangcagcacactgttctagttcatttttgttttcctt

SEQ ID NO: 42478 - DNA, 71 bp, chicken (Gallus Gallus)
  misc_feature (36): n=c or t
attctacaacatacccatgtatacatgttacacctngatgaaaaacgttcttaaatacattgtaatacttc

SEQ ID NO: 42479 - DNA, 71 bp, chicken (Gallus Gallus)
  misc_feature (36): n=a or g
aaagatgagaagagtggcagagcacatgggtaaatnttttagctgggttctgggaaaagaaactggaggtc

SEQ ID NO: 42480 - DNA, 71 bp, chicken (Gallus Gallus)
  misc_feature (36): n=c or t
catggaaaatgtggtgacaaaggactttgtttaganccatagcataggagattctgctccaattggctgtt

SEQ ID NO: 42481 - DNA, 71 bp, chicken (Gallus Gallus)
  misc_feature (36): n=c or t
aattcaaagctattttgtctcccattttttccccangatttatgccatttccctggctacaagttgtgtaa

SEQ ID NO: 42482 - DNA, 71 bp, chicken (Gallus Gallus)
  misc_feature (36): n=a or g
gacaaactaggctgcctgattcttctaaactgtgcnttgcttttcatgaaaattccctttaaaaatacatt

SEQ ID NO: 42483 - DNA, 71 bp, chicken (Gallus Gallus)
  misc_feature (36): n=a or g
ctatccagctcaagcaaaatgccagtgttttctccnttcctcctatatctccagcagtatttttgcggttt

SEQ ID NO: 42484 - DNA, 71 bp, chicken (Gallus Gallus)
  misc_feature (36): n=c or t
ctgctgagcaaatacagttatcagatgtattcagcncttaaaattcaagtgagagcagcttatgtggctgc

SEQ ID NO: 42485 - DNA, 71 bp, chicken (Gallus Gallus)
  misc_feature (36): n=c or t
cattttatgtttccctaaagaattagccaacaattncacattaagctatgcttataggtagattgtgctgt

SEQ ID NO: 42486 - DNA, 71 bp, chicken (Gallus Gallus)
  misc_feature (36): n=a or g
tcttgcttgagtgatagtttataccctttaacaatngaagccactcatgttcctctctgagcagtgatggt

SEQ ID NO: 42487 - DNA, 71 bp, chicken (Gallus Gallus)
  misc_feature (36): n=a or g
atgaaagcttgactttgagagtggcacctgagaaanggtgactccctcatggcagaattagtcctgttgct

SEQ ID NO: 42488 - DNA, 71 bp, chicken (Gallus Gallus)
  misc_feature (36): n=c or t
ccagtgtgttacaggtataggtgggacacctggtangatggggatgttgtccttttttcaagttacctcat

SEQ ID NO: 42489 - DNA, 71 bp, chicken (Gallus Gallus)
  misc_feature (36): n=a or g
acactattaaaaagctgtagaagaaattgcagaatntttacacatcaaatattgttttgacaattactact

SEQ ID NO: 42490 - DNA, 71 bp, chicken (Gallus Gallus)
  misc_feature (36): n=a or g
cggtatctcaacaaggcagcagtcccactgcctcantggacttatctcatttagcgcacagccttagagaa

SEQ ID NO: 42491 - DNA, 71 bp, chicken (Gallus Gallus)
  misc_feature (36): n=c or t
agcgagtacaagtgacattgaagagactcataatantttcattacatgctttttcctaagttgattggttc

SEQ ID NO: 42492 - DNA, 71 bp, chicken (Gallus Gallus)
  misc_feature (36): n=c or t
tacccttggcactatcagtgatttcgctgtatgtcngtatcaactatttttgtctgatgctggtcatattg

SEQ ID NO: 42493 - DNA, 71 bp, chicken (Gallus Gallus)
  misc_feature (36): n=a or c
agatttctcgcagtaagcaatgtctgcctagaaccnagcaaactgaacacctttacttccaaaatatttcc

SEQ ID NO: 42494 - DNA, 71 bp, chicken (Gallus Gallus)
  misc_feature (36): n=a or g
aggagattactaccctgctgtaaatgaaggcaaatncgtaacagaaattggaatgacgatgtgtttccctc

SEQ ID NO: 42495 - DNA, 71 bp, chicken (Gallus Gallus)
  misc_feature (36): n=c or t
tgcagaatcacttcaagtccactggaggttttccantaatctgggcttgtgattattgtctcttcttgtat

SEQ ID NO: 42496 - DNA, 71 bp, chicken (Gallus Gallus)
  misc_feature (36): n=g or t
tgtcctttctggtattttgaacatctatttcctggnagaatatcctcattgaagggctataattaaggctg

SEQ ID NO: 42497 - DNA, 71 bp, chicken (Gallus Gallus)
  misc_feature (36): n=a or g
tttgctttatcaagagaggaagctccagttgttttntttcatttgttgcaaatgatgtgcgttaggcagat

SEQ ID NO: 42498 - DNA, 71 bp, chicken (Gallus Gallus)
  misc_feature (36): n=a or g
ttagtgagagggaccagaaaacaaaagagctaaccnactccactcactaagttaagtcacatgaagagtat

SEQ ID NO: 42499 - DNA, 71 bp, chicken (Gallus Gallus)
  misc_feature (36): n=g or t
agtacagtttagttacctatgcaaagtaaacttgtnatcctatgaagagatttgaaaaacactttttttat

SEQ ID NO: 42500 - DNA, 71 bp, chicken (Gallus Gallus)
  misc_feature (36): n=a or g
taggctggaccacaggtaatgttaagctcctgcctntcccttttgaacagatgctcaagtttgaaatcttc

SEQ ID NO: 42501 - DNA, 71 bp, chicken (Gallus Gallus)
  misc_feature (36): n=c or t
cgggttttagtgtaacatctttgacttcagttctgnttcttcgtttgctttcaggaatctccttctggccg

SEQ ID NO: 42502 - DNA, 71 bp, chicken (Gallus Gallus)
  misc_feature (36): n=a or g
tattttgtctgttccgagagttttattatttggttngtttttgttcttgatattcttttcattgggttatg

SEQ ID NO: 42503 - DNA, 71 bp, chicken (Gallus Gallus)
  misc_feature (36): n=a or g
tttatgtttgtttcattagctagcttacacatttcnaatcattttgttcctattgtatctttgtttttagg

SEQ ID NO: 42504 - DNA, 71 bp, chicken (Gallus Gallus)
  misc_feature (36): n=a or c
aaactttttggagcaactgtaatcagtgtggctganggaagaaccagaaggaaaagaggtgtcagtgtacc

SEQ ID NO: 42505 - DNA, 71 bp, chicken (Gallus Gallus)
  misc_feature (36): n=c or t
cctaaaattaagtaatacttatcacactttttccangcagaatttgagaataacaaatcatagaatcagaa

SEQ ID NO: 42506 - DNA, 71 bp, chicken (Gallus Gallus)
  misc_feature (36): n=a or g
ctttagctgtccaaaggatgagattaatactctggntgtgcataacactagaaatgtagaaattcaaaata

SEQ ID NO: 42507 - DNA, 71 bp, chicken (Gallus Gallus)
  misc_feature (36): n=a or g
atagctgaagtagaactggggtcttcaagcagctcntaaaattgcagttattgctagttggcaaaagctga

SEQ ID NO: 42508 - DNA, 71 bp, chicken (Gallus Gallus)
  misc_feature (36): n=a or g
tattcagtattttggggtcattgaggttaatgatangaacctttactcaagcatctctttcttagtgcact

SEQ ID NO: 42509 - DNA, 71 bp, chicken (Gallus Gallus)
  misc_feature (36): n=c or t
aaacacctttagcaatccactaatattgtgtaatgntcttccttgtatgtttatcaacctttaaaaagaaa

SEQ ID NO: 42510 - DNA, 71 bp, chicken (Gallus Gallus)
  misc_feature (36): n=a or g
tgcaacatattgatgggcctgtgtattgaacagtgnaagtaagccactgctgggtagagctcagctctaag

SEQ ID NO: 42511 - DNA, 71 bp, chicken (Gallus Gallus)
  misc_feature (36): n=a or g
ggctgctttcttaccctttgctcgtgccatgcccantaaaacagagcaggataggtgtgcatgatgctgtg

SEQ ID NO: 42512 - DNA, 71 bp, chicken (Gallus Gallus)
  misc_feature (36): n=g or t
aacagaaaatacacattactttcccagagttgaacnccttgattgcaaatatattgttttactgatataat

SEQ ID NO: 42513 - DNA, 71 bp, chicken (Gallus Gallus)
  misc_feature (36): n=c or t
agatcgagcaccctgcttttgggacagcagagcttntactgttaagtgagctatctggtgccaggtggtct

SEQ ID NO: 42514 - DNA, 71 bp, chicken (Gallus Gallus)
  misc_feature (36): n=a or c
atattattcaaatagtagctctctctatcttgtaantgtagacctcggggcactttaaaatggacttatgc

SEQ ID NO: 42515 - DNA, 71 bp, chicken (Gallus Gallus)
  misc_feature (36): n=a or g
cacaaaataactcccatattaacacaagttcctacngaggacagccaaagtctcacagctccagaatttgt

SEQ ID NO: 42516 - DNA, 71 bp, chicken (Gallus Gallus)
  misc_feature (36): n=a or g
cccatacttgggtatccagatcagaagattgctttnctatgcctgaaatcctaatgtgaaaaaaaaaaaca

SEQ ID NO: 42517 - DNA, 71 bp, chicken (Gallus Gallus)
  misc_feature (36): n=a or c
gtgagcttctatgctgtaaaagccaagatgctcttnatttctgctggtatagttagcctgcatagttaact

SEQ ID NO: 42518 - DNA, 71 bp, chicken (Gallus Gallus)
  misc_feature (36): n=c or t
tatacaataacctcagctatgtgcttcagcagtttnagaccaatctcacccagccccagggttttgagtat

SEQ ID NO: 42519 - DNA, 71 bp, chicken (Gallus Gallus)
  misc_feature (36): n=a or g
gcagagaggctgcgtttctgtagagattttcaagcntaaatgtaaagcctgcaaaaatgctgcagaaaagg

SEQ ID NO: 42520 - DNA, 71 bp, chicken (Gallus Gallus)
  misc_feature (36): n=a or g
ctgcttatgacacagagtgaaatctgtcattctgcnctcggccctgatcccagctagagctatcgtctgga

SEQ ID NO: 42521 - DNA, 71 bp, chicken (Gallus Gallus)
  misc_feature (36): n=a or g
gaaaactaaaggactctattctttcttcagcattcntgttagctatgcacagaaatcccacatatatcacc

SEQ ID NO: 42522 - DNA, 71 bp, chicken (Gallus Gallus)
  misc_feature (36): n=c or t
gcaaaaggtgcaaatcaaacaagtgtaaaagagatnggtttttgtgagggaaactgttgttcaagaatttg

SEQ ID NO: 42523 - DNA, 71 bp, chicken (Gallus Gallus)
  misc_feature (36): n=a or c
tagcatcccttagtggggagccctgtgttttgcctnctgcttagtgcagatctgtcttccctaggcacaca

SEQ ID NO: 42524 - DNA, 71 bp, chicken (Gallus Gallus)
  misc_feature (36): n=c or t
agactttaaaagaaaagaaggattatatttatcttnaattgtgacactttatataacaaattaatactaga

SEQ ID NO: 42525 - DNA, 71 bp, chicken (Gallus Gallus)
  misc_feature (36): n=c or t
acaatgagaaatagtgaatgtggagttgcctgtcantgactttacttaatctctttcttgactaaattcat

SEQ ID NO: 42526 - DNA, 71 bp, chicken (Gallus Gallus)
  misc_feature (36): n=a or c
taattccttgccacatgctgccttttcttgtgaggnaatgatgatgggagttctttttttgctggatgact

SEQ ID NO: 42527 - DNA, 71 bp, chicken (Gallus Gallus)
  misc_feature (36): n=a or g
catagtgtagcactatggtaaaacagtggtccaaancaatggaaacacctgttcttccattacattacacc

SEQ ID NO: 42528 - DNA, 71 bp, chicken (Gallus Gallus)
  misc_feature (36): n=a or g
attacaagaacagttatgaagcatgcatgatggttnaatgacttttgacagaaaccgtatttaactttgtt

SEQ ID NO: 42529 - DNA, 71 bp, chicken (Gallus Gallus)
  misc_feature (36): n=c or t
ttcctttgatctacttgtagcatctcagcgaccccntaaaaatgtcttgttgccttgagagtaatgcaaaa

SEQ ID NO: 42530 - DNA, 71 bp, chicken (Gallus Gallus)
  misc_feature (36): n=a or g
gtatttgaccagcgggcagtcactgcttggggactnctgagtttttttggtcagcaggtaggtgctgcttc

SEQ ID NO: 42531 - DNA, 71 bp, chicken (Gallus Gallus)
  misc_feature (36): n=a or g
ggcagggaaaataataggatcctgactcacatatcngacaccacaagaaaagataataaatactagtgaaa

SEQ ID NO: 42532 - DNA, 71 bp, chicken (Gallus Gallus)
  misc_feature (36): n=a or g
gagctttctgaattaactctgcttagtactgctatntggattggagattcttttacgcttgtatgcaaaca

SEQ ID NO: 42533 - DNA, 71 bp, chicken (Gallus Gallus)
  misc_feature (36): n=c or t
aattttaaatgcatttaaatctctcctatgtaatcntttccataatacgtacagtaagttttaaaactgat

SEQ ID NO: 42534 - DNA, 71 bp, chicken (Gallus Gallus)
  misc_feature (36): n=c or t
agtttttaattactcttcctgtaaaagttaaagcanacagaatcctaacatatcagcctcatgttgtgaca

SEQ ID NO: 42535 - DNA, 71 bp, chicken (Gallus Gallus)
  misc_feature (36): n=c or t
ttaaaaggaaaaacaaacatttagtacaaacggccngagattaaaatgttacaatgcagaacatatataca

SEQ ID NO: 42536 - DNA, 71 bp, chicken (Gallus Gallus)
  misc_feature (36): n=g or t
tggcctggtttatgacccttgaaatgagtttaaatnagtttggtgatttttgaaatactaaattattttcc

SEQ ID NO: 42537 - DNA, 71 bp, chicken (Gallus Gallus)
  misc_feature (36): n=a or c
tgttaccttgtgttgggtctgacttatttccaaggnctttactgttgacagaccagtttgtttactatact

SEQ ID NO: 42538 - DNA, 71 bp, chicken (Gallus Gallus)
  misc_feature (36): n=c or t
gttagttttcaaaggaaacattaccttctgaccagnttcacaaagtaaatcctatttaatcatcctgcaaa

SEQ ID NO: 42539 - DNA, 71 bp, chicken (Gallus Gallus)
  misc_feature (36): n=a or g
agatacagggtacagacaacagcgcagcatcctgtntgtctttatgctctgacccactcactgttagtaat

SEQ ID NO: 42540 - DNA, 71 bp, chicken (Gallus Gallus)
  misc_feature (36): n=c or t
actatttctccctgttgtgcaaagcagtgagtagcntcattctaaagagtggcatcttgctcagcatttat

SEQ ID NO: 42541 - DNA, 71 bp, chicken (Gallus Gallus)
  misc_feature (36): n=g or t
tatttttcattgaaagatctacacagagaattgctnttgaatacttctcttccagcaaacaaccttgcaag

SEQ ID NO: 42542 - DNA, 71 bp, chicken (Gallus Gallus)
  misc_feature (36): n=c or t
cactacatttaaaacacaccaacacttcacgaggcnttataaaacaagaagcaattgaatgaagaagctat

SEQ ID NO: 42543 - DNA, 71 bp, chicken (Gallus Gallus)
  misc_feature (36): n=c or t
acataccatacataattcaggctattaatactaagnagaagagtgctgcactgtgattatccatgtctagc

SEQ ID NO: 42544 - DNA, 71 bp, chicken (Gallus Gallus)
  misc_feature (36): n=a or g
tcagctcagatctttacttgcaatatctgatttttnttgtcagagttttttcatatatcttcatcattaaa

SEQ ID NO: 42545 - DNA, 71 bp, chicken (Gallus Gallus)
  misc_feature (36): n=a or g
tatccctccatgttccttaagacagagtgccccacngaagaggaatacgtgttcctgctgcttggctcact

SEQ ID NO: 42546 - DNA, 71 bp, chicken (Gallus Gallus)
  misc_feature (36): n=c or t
atagttgtggaccgcagatgaaatacatcccataanccacagccagctaggacttctcagccatcaattgc

SEQ ID NO: 42547 - DNA, 71 bp, chicken (Gallus Gallus)
  misc_feature (36): n=a or g
attccagaatttttctgcctagtagatttctatacncagcacccaccttatccagctactagactggagac

SEQ ID NO: 42548 - DNA, 71 bp, chicken (Gallus Gallus)
  misc_feature (36): n=g or t
taaaataatgactcatctgttaaagcaatttcttgnctggcagagtttgggggaagtttttttgtaggtgt

SEQ ID NO: 42549 - DNA, 71 bp, chicken (Gallus Gallus)
  misc_feature (36): n=a or g
agtgcagacacttaaggaaaagaattccccagttcnagtctatcaagtacctctttatgtttaaatgactg

SEQ ID NO: 42550 - DNA, 71 bp, chicken (Gallus Gallus)
  misc_feature (36): n=c or t
agccaaaagcaccactccaatgacataagccaattnactccctgttttattaaacttccacagtgtttaga

SEQ ID NO: 42551 - DNA, 71 bp, chicken (Gallus Gallus)
  misc_feature (36): n=c or t
gctgagacacatgagactggttctattctgtcttcnacttatcacaatttgaacccaggccacttttctcc

SEQ ID NO: 42552 - DNA, 71 bp, chicken (Gallus Gallus)
  misc_feature (36): n=c or t
ctcctgagttatccaagcttaagcaagagtagactnaggctctcagctgggctgggattttctttctattt

SEQ ID NO: 42553 - DNA, 71 bp, chicken (Gallus Gallus)
  misc_feature (36): n=a or g
gaagtaaatcaattgcaatgaagcatctcccatctntctttacttagggttatttttcagagacgtggcct

SEQ ID NO: 42554 - DNA, 71 bp, chicken (Gallus Gallus)
  misc_feature (36): n=a or g
agttgaggatctggctcatttgcacaattgcgatgngtttatactagctacatttacgaaaagtctgactg

SEQ ID NO: 42555 - DNA, 71 bp, chicken (Gallus Gallus)
  misc_feature (36): n=g or t
gtaagatgtgttcactgctctgaataatctcaactncataccttcagtaaatcagacaggcgggtgagcat

SEQ ID NO: 42556 - DNA, 71 bp, chicken (Gallus Gallus)
  misc_feature (36): n=c or t
tttgcactacaaactaagtgatcatgactgatttcnccaaagttgaaacccaattttgtgaagcctatgta

SEQ ID NO: 42557 - DNA, 71 bp, chicken (Gallus Gallus)
  misc_feature (36): n=g or t
ttcatttaaagtccctttttttcttatatggtctangaagcatacacagtacaggatacgtgcaagcatat

SEQ ID NO: 42558 - DNA, 71 bp, chicken (Gallus Gallus)
  misc_feature (36): n=a or g
taaatgaagtaactcaaaggataactcaaagcacancttgaaacaccaagcacgtgcttaaattatttttt

SEQ ID NO: 42559 - DNA, 71 bp, chicken (Gallus Gallus)
  misc_feature (36): n=a or g
agcttggacattaaaaagaacatttgctcatatacnaacttgtataaagacaggaataaaaagtcatcaca

SEQ ID NO: 42560 - DNA, 71 bp, chicken (Gallus Gallus)
  misc_feature (36): n=c or t
aaagtcttactttgctgtttacaggaatcatataancccagtggacacttcctacaatactgcaaagcacc

SEQ ID NO: 42561 - DNA, 71 bp, chicken (Gallus Gallus)
  misc_feature (36): n=c or t
agcaatgtcaccatcatgcctgttctgagaattccnttccttgaaggacatcagcaaccaaagtcagaaat

SEQ ID NO: 42562 - DNA, 71 bp, chicken (Gallus Gallus)
  misc_feature (36): n=a or c
cttgaataaaagagagaatatgtccaagtgttgctntgtgcatatacaaggacaaatgtgctatgttcctt

SEQ ID NO: 42563 - DNA, 71 bp, chicken (Gallus Gallus)
  misc_feature (36): n=a or g
gacagcagaatggaaggttttccagtgtcctgggcnattcttgctctctctacccatcactgaaaccattc

SEQ ID NO: 42564 - DNA, 71 bp, chicken (Gallus Gallus)
  misc_feature (36): n=c or t
tttcgggtcagttttctttcatactcattttcacangtttcatttgcacagaaatttctatataatggcat

SEQ ID NO: 42565 - DNA, 71 bp, chicken (Gallus Gallus)
  misc_feature (36): n=c or t
attaacagcagcagcattttcaccttgttttcatgnagtggtggtctctttttgctatttgaattgtcctg

SEQ ID NO: 42566 - DNA, 71 bp, chicken (Gallus Gallus)
  misc_feature (36): n=a or g
ttacccctatttcttccatttgcagacctttctcancagagagggatttagctgtcataacaaaaaacccc

SEQ ID NO: 42567 - DNA, 71 bp, chicken (Gallus Gallus)
  misc_feature (36): n=c or t
atccggataaagcttcaagcaactacagagtacccnatgcaagacttccacagaacctagtgccagttcct

SEQ ID NO: 42568 - DNA, 71 bp, chicken (Gallus Gallus)
  misc_feature (36): n=a or g
aaggtgttgatgctaagttggtctatgaaatcccanaatcgttcaatcacgtcctgtacttgcttctcaca

SEQ ID NO: 42569 - DNA, 71 bp, chicken (Gallus Gallus)
  misc_feature (36): n=c or t
ggatgctctgccagcatttttcactgtacgtacaantttgctatcggagtcatttccctgtagagcttagt

SEQ ID NO: 42570 - DNA, 71 bp, chicken (Gallus Gallus)
  misc_feature (36): n=c or t
ctggagtttacagaagatgccagtaagctccaacangagtgcgatccccgcagaactcagaacaactttac

SEQ ID NO: 42571 - DNA, 71 bp, chicken (Gallus Gallus)
  misc_feature (36): n=c or t
ctccagcccttcctgctgtgactgccaggcttcatnctgctttagacattcagagatgcgtggatctgaac

SEQ ID NO: 42572 - DNA, 71 bp, chicken (Gallus Gallus)
  misc_feature (36): n=c or t
gatgactcctgacattcaccttcattagccatcganggctgcgctcagctgcctcggcacagagctattga

SEQ ID NO: 42573 - DNA, 71 bp, chicken (Gallus Gallus)
  misc_feature (36): n=c or t
tgacattttccttgtgaaggtcaagaaaagtcattnctaagaaactgcaggatgggcaataatgaaaagag

SEQ ID NO: 42574 - DNA, 71 bp, chicken (Gallus Gallus)
  misc_feature (36): n=a or g
tgcacctgattgccacaggaagacttcaagacatgnaacaaattgctccagtgataatgcaggtaaataac

SEQ ID NO: 42575 - DNA, 71 bp, chicken (Gallus Gallus)
  misc_feature (36): n=c or t
cttaggtcttctcttccattatcttaatcagatagngttagtagcttaagagtttttgcctgcataagcat

SEQ ID NO: 42576 - DNA, 71 bp, chicken (Gallus Gallus)
  misc_feature (36): n=g or t
gctgccctctaatctgagcttaacatatatacaggngtctatagctagatttgatcacaaaatatatgttg

SEQ ID NO: 42577 - DNA, 71 bp, chicken (Gallus Gallus)
  misc_feature (36): n=a or g
gtgcgttatcagaaaacagatccagagcacgagcantgatatcagatctagttctccctccatcataatca

SEQ ID NO: 42578 - DNA, 71 bp, chicken (Gallus Gallus)
  misc_feature (36): n=c or t
agcttgtgtgccattctgctaccaacgatcagtgcngtcttctcagcagttaagacctcttaaacaaagaa

SEQ ID NO: 42579 - DNA, 71 bp, chicken (Gallus Gallus)
  misc_feature (36): n=a or g
tcagactgcttccctataaacttcaaaagcgaaaangcttacaataaccaatttccaatgcaaaaaatgtt

SEQ ID NO: 42580 - DNA, 71 bp, chicken (Gallus Gallus)
  misc_feature (36): n=g or t
cttgaaatatggaaagtattaagtccagcactattnttaattgttcaatacatgatgttgctggcataccc

SEQ ID NO: 42581 - DNA, 71 bp, chicken (Gallus Gallus)
  misc_feature (36): n=a or g
ggttcagagattgggagcccatttagacaaataccnaaattatttttgaaacatgtgttttgcacctgggt

SEQ ID NO: 42582 - DNA, 71 bp, chicken (Gallus Gallus)
  misc_feature (36): n=a or g
gtcatttgggtgttttcttgataggacttcaataantctgttgtttcacatttttgactgtagtgaatcag

SEQ ID NO: 42583 - DNA, 71 bp, chicken (Gallus Gallus)
  misc_feature (36): n=c or t
tttactacattttcagtgatctgaaaagtagagctncctcccctccctgctgcacctaacccagtaactaa

SEQ ID NO: 42584 - DNA, 71 bp, chicken (Gallus Gallus)
  misc_feature (36): n=a or c
taatttggtcagccaggaaaagtaccatttgaatanatctgcttgcaataaagagatgaactgtggaattt

SEQ ID NO: 42585 - DNA, 71 bp, chicken (Gallus Gallus)
  misc_feature (36): n=a or g
cacatagatggcctgaaataaaaatcaggccaggtngatgttaatgggcacattcaaaggctgttgaagtg

SEQ ID NO: 42586 - DNA, 71 bp, chicken (Gallus Gallus)
  misc_feature (36): n=a or g
tagcaaccttgcagactctgaaagacagagcatttntattcctgtttgcagagtatgtttcccttaactga

SEQ ID NO: 42587 - DNA, 71 bp, chicken (Gallus Gallus)
  misc_feature (36): n=a or c
tttttttttaatagtcacatccacatttttcagttnttcttaactacgtggaaaatttaactttcaaaatt

SEQ ID NO: 42588 - DNA, 71 bp, chicken (Gallus Gallus)
  misc_feature (36): n=c or t
gcggaagcattaaggtttacagcacctctgtgaggntggcaagaggtatccagagacgttttcaccaatgg

SEQ ID NO: 42589 - DNA, 71 bp, chicken (Gallus Gallus)
  misc_feature (36): n=c or t
gtgggaagataaaaaattgagcaagctggcatatcngcttgccagagctctagaaaaacatgcatcttgca

SEQ ID NO: 42590 - DNA, 71 bp, chicken (Gallus Gallus)
  misc_feature (36): n=a or g
aatatttatatgaattgaagcagatccagcagaagnaactagagacatcacagaaaagaataagctagcac

SEQ ID NO: 42591 - DNA, 71 bp, chicken (Gallus Gallus)
  misc_feature (36): n=g or t
tggagaagatactttggtgcataaggcagtagtgangagtgttttataaggtaatactaatgatttaacag

SEQ ID NO: 42592 - DNA, 71 bp, chicken (Gallus Gallus)
  misc_feature (36): n=a or g
atatggctctcagctttctgacaagagatacactanaaattgacattaaagtagtcataaggaattgcttt

SEQ ID NO: 42593 - DNA, 71 bp, chicken (Gallus Gallus)
  misc_feature (36): n=a or g
gctctactttggtagctatctgatacgtaacatcanttttaccaaataaggagatcttatgagtcttatga

SEQ ID NO: 42594 - DNA, 71 bp, chicken (Gallus Gallus)
  misc_feature (36): n=c or t
gcaaacagctaccgctagctgcaaaaggaatgaggnattaaaaaagccaatagctgcttcctgcataactg

SEQ ID NO: 42595 - DNA, 71 bp, chicken (Gallus Gallus)
  misc_feature (36): n=c or t
atcttagatgacttgataagaatcttagctgctccngtaccataggtagcttggggatcttttgctttatt

SEQ ID NO: 42596 - DNA, 71 bp, chicken (Gallus Gallus)
  misc_feature (36): n=c or t
catagtagttaaaaatgaattaccagatacatctancaaccagaacatgccatgctgttctaactgcacag

SEQ ID NO: 42597 - DNA, 71 bp, chicken (Gallus Gallus)
  misc_feature (36): n=c or t
gaatattctgctgcacctctgagctccatatgctcnattcttgaccagtacatagggcacagctttacaaa

SEQ ID NO: 42598 - DNA, 71 bp, chicken (Gallus Gallus)
  misc_feature (36): n=a or c
tgattccatccaaaggacaaggagaatgttcccagngaagtccacagggccaccacttcttctttttggtt

SEQ ID NO: 42599 - DNA, 71 bp, chicken (Gallus Gallus)
  misc_feature (36): n=c or t
tattcagacatgagtcagagatgcattaaaagcccntggatagcagactgaccttttttttccccaaagct

SEQ ID NO: 42600 - DNA, 71 bp, chicken (Gallus Gallus)
  misc_feature (36): n=a or g
ttctaaccacagtctcttgatactggtgagtaagangagagtagggtcttgggatgaaatgtctgtttgtt

SEQ ID NO: 42601 - DNA, 71 bp, chicken (Gallus Gallus)
  misc_feature (36): n=a or g
gttattccacagtgtctgcaggagtaatggggctgncaaatcagatgcagtattgctggagctccagaaca

SEQ ID NO: 42602 - DNA, 71 bp, chicken (Gallus Gallus)
  misc_feature (36): n=a or g
atcggcaataacattcaatgcccaatgtctttttgnagtggttatagcatcaatgacagaattgtggtgta

SEQ ID NO: 42603 - DNA, 71 bp, chicken (Gallus Gallus)
  misc_feature (36): n=c or t
ctctgtatttgatcagcacagtcatctctgttcatngaggaggctgttgggagggtatttcatgcagatta

SEQ ID NO: 42604 - DNA, 71 bp, chicken (Gallus Gallus)
  misc_feature (36): n=a or c
tatactgctttatttttattatgacttataggtctntagggcatgtcctctgtagtgtttgtatttgtcat

SEQ ID NO: 42605 - DNA, 71 bp, chicken (Gallus Gallus)
  misc_feature (36): n=c or t
gaacactttgcagttcaaattgaaggcacaagactncatcttagtacactgactcattttgggggggatct

SEQ ID NO: 42606 - DNA, 71 bp, chicken (Gallus Gallus)
  misc_feature (36): n=c or t
gtagatatgagaattgttcacagcttttgatggganggatgtaacactgtgagatgctggaaacagacagc

SEQ ID NO: 42607 - DNA, 71 bp, chicken (Gallus Gallus)
  misc_feature (36): n=g or t
atgtgggaccagacgaatgacaagccggttctgcancccggcaccggagaggctccgggtcgtactgctgc

SEQ ID NO: 42608 - DNA, 71 bp, chicken (Gallus Gallus)
  misc_feature (36): n=c or t
ataaatcatggtatgctatatagtcttgagcatacngatcattatgatgctccatgaaataaccacttttg

SEQ ID NO: 42609 - DNA, 71 bp, chicken (Gallus Gallus)
  misc_feature (36): n=a or g
ctcagctagattgaaacccatatgaaaatatctttnttgtgttcttgtgcacagaaacctagtgtgggaaa

SEQ ID NO: 42610 - DNA, 71 bp, chicken (Gallus Gallus)
  misc_feature (36): n=c or t
agcttccacatttctggctgaaaagttatccacttngtactccttgcaacgcttgccaggaatgatggtag

SEQ ID NO: 42611 - DNA, 71 bp, chicken (Gallus Gallus)
  misc_feature (36): n=a or g
ggttatgcattacatactagtactccttcattgtcnatttaagtcatactgaagtcagctttgctccatgt

SEQ ID NO: 42612 - DNA, 71 bp, chicken (Gallus Gallus)
  misc_feature (36): n=a or g
tatttcaataagcactatctacattaacatagcgantactcttgttaccctctgtcataatccaaagatta

SEQ ID NO: 42613 - DNA, 71 bp, chicken (Gallus Gallus)
  misc_feature (36): n=g or t
gaaacacagaaatataagagatatgatcattttcanttctgctgctgtggattgcttcttcatttcaaatt

SEQ ID NO: 42614 - DNA, 71 bp, chicken (Gallus Gallus)
  misc_feature (36): n=c or t
tgtaattagacaggagctatagaaatgcattaattncagtaactcttccctttagcttaattagctttgtg

SEQ ID NO: 42615 - DNA, 71 bp, chicken (Gallus Gallus)
  misc_feature (36): n=a or g
actacaatttcctctggagcaatgatagagcaacanaagttttttgatcctccagccctataaggcacagg

SEQ ID NO: 42616 - DNA, 71 bp, chicken (Gallus Gallus)
  misc_feature (36): n=c or t
gctggtgaactcagtacatttgaattaataagttangtcctggccatcttttcaatcgtaaccttcagtgc

SEQ ID NO: 42617 - DNA, 71 bp, chicken (Gallus Gallus)
  misc_feature (36): n=a or c
agacagacgtggagatggaaaagagcaacaagaagnagcaaaatcttcctgtaaaccccaggaaagcagat

SEQ ID NO: 42618 - DNA, 71 bp, chicken (Gallus Gallus)
  misc_feature (36): n=c or t
tatgatatacattctatatgtacaacctgattattncactctcaaagcctaacaactgaacaagttaggca

SEQ ID NO: 42619 - DNA, 71 bp, chicken (Gallus Gallus)
  misc_feature (36): n=c or t
aacttgccacagatgctccttgttcattgatgttgnttttatttaattcatcctcatcttaagaactgttt

SEQ ID NO: 42620 - DNA, 71 bp, chicken (Gallus Gallus)
  misc_feature (36): n=g or t
tccaagaatcactgtccccatcacagagtttagggntctcagctcatttatacacaaataaaatcatttgg

SEQ ID NO: 42621 - DNA, 71 bp, chicken (Gallus Gallus)
  misc_feature (36): n=a or g
ttttctctagaacaataaatccaggagacagagttntatggcaacatgggaatctagagtgatatttgtaa

SEQ ID NO: 42622 - DNA, 71 bp, chicken (Gallus Gallus)
  misc_feature (36): n=a or g
cacattgctcaccttataagggcaaagggtgctcancagtgtgctccagcaggcatgagaacatgcgaaag

SEQ ID NO: 42623 - DNA, 71 bp, chicken (Gallus Gallus)
  misc_feature (36): n=g or t
gcacatttggtgtcaagtcagtgtgaagtcactgtnctctgaaatgccaaaccacctttggcaacacctga

SEQ ID NO: 42624 - DNA, 71 bp, chicken (Gallus Gallus)
  misc_feature (36): n=a or g
ccttttgcactccaggaaagcattgtctcaagtggngcacagttttatgcttgggtaaaaaaaagtccgct

SEQ ID NO: 42625 - DNA, 71 bp, chicken (Gallus Gallus)
  misc_feature (36): n=a or c
atagtttatcccagcgatagtgtggtctgctcttgnaagccactctctttcatacatcagaatgacagctt

SEQ ID NO: 42626 - DNA, 71 bp, chicken (Gallus Gallus)
  misc_feature (36): n=a or g
ataaccaaatgtgtattcatattttagtaaagcatngacacttttttgcttaaccatgcttgccctgtatt

SEQ ID NO: 42627 - DNA, 71 bp, chicken (Gallus Gallus)
  misc_feature (36): n=a or g
gtttgccctctagagccttcaccatctttttaatgnagcagcttccagggaggatctgaagaagtgacaac

SEQ ID NO: 42628 - DNA, 71 bp, chicken (Gallus Gallus)
  misc_feature (36): n=c or t
acaaatctaaaatacagattacttattatacactanatgtgttgagctgaacactgatccaaattacactg

SEQ ID NO: 42629 - DNA, 71 bp, chicken (Gallus Gallus)
  misc_feature (36): n=a or g
caattagagagctcatatatgacactgtatttttcnttatttaaaacaacagatagtactcttgggtgaaa

SEQ ID NO: 42630 - DNA, 71 bp, chicken (Gallus Gallus)
  misc_feature (36): n=c or t
agcatgaagaacatttcaccaacatagcagatattntgaaatgctctgacaagattgatcagatatccttc

SEQ ID NO: 42631 - DNA, 71 bp, chicken (Gallus Gallus)
  misc_feature (36): n=c or t
atctgcatgcagtctgcttttaacacaaaaacattntactagctataatgctcttcctgggacactaacca

SEQ ID NO: 42632 - DNA, 71 bp, chicken (Gallus Gallus)
  misc_feature (36): n=c or t
actctttccaggtgaaagtctcctaataaaagccanctgaagatcactaataacttcaactcctactaaaa

SEQ ID NO: 42633 - DNA, 71 bp, chicken (Gallus Gallus)
  misc_feature (36): n=c or t
ttaattctatattgttgaaacatgctgacacatatngccattttcagtcttatagggattgaccattctca

SEQ ID NO: 42634 - DNA, 71 bp, chicken (Gallus Gallus)
  misc_feature (36): n=a or g
aatccacagtgtatctgcaacttcagctcactttancagatgaaaccatgtggtaaacaccactcagcttg

SEQ ID NO: 42635 - DNA, 71 bp, chicken (Gallus Gallus)
  misc_feature (36): n=a or c
tagggcaaaagtcttaacctggctttgccatgctgnagacctatatcctaattaataagcaacaaacagta

SEQ ID NO: 42636 - DNA, 71 bp, chicken (Gallus Gallus)
  misc_feature (36): n=a or g
atatagccctgtaaaaaacagcaatagtagatatanctgctttaaaccagcttaggatcacccacaaaaga

SEQ ID NO: 42637 - DNA, 71 bp, chicken (Gallus Gallus)
  misc_feature (36): n=c or t
agtttgtgtagccttgaatattacagaagttcatcnctctaaagccatataatccatattcctagtcactg

SEQ ID NO: 42638 - DNA, 71 bp, chicken (Gallus Gallus)
  misc_feature (36): n=a or g
tctctcttctttacgtttgttactttatggtgtagntcccatgaaagaccaattgtcatccacaaaacttt

SEQ ID NO: 42639 - DNA, 71 bp, chicken (Gallus Gallus)
  misc_feature (36): n=a or g
gtaggaccaaaagccacaagggtaccttagagtacncctgcccatgcaagaggatggtcctgatgaaactg

SEQ ID NO: 42640 - DNA, 71 bp, chicken (Gallus Gallus)
  misc_feature (36): n=a or g
ggagaatgtctgttcagtactcagttgaaactgccnttatggtatgtgccaagaagatgtgggcttgtaca

SEQ ID NO: 42641 - DNA, 71 bp, chicken (Gallus Gallus)
  misc_feature (36): n=g or t
tatgttgttcctggggaagtctgtattgctgttgcntatggatgaacaggcctcgagagaaccacagcctc

SEQ ID NO: 42642 - DNA, 71 bp, chicken (Gallus Gallus)
  misc_feature (36): n=c or t
tgtgaatgtattctgctcttaaggtgtctccctgcnttgaacctgctggcacggcatgtctccaaatctcc

SEQ ID NO: 42643 - DNA, 71 bp, chicken (Gallus Gallus)
  misc_feature (36): n=a or g
gtgaatgggctcttcatcctgttaatccctatgagngtgcagaaggatgtcttgccagcacactctggggc

SEQ ID NO: 42644 - DNA, 71 bp, chicken (Gallus Gallus)
  misc_feature (36): n=a or g
ctcctctgtgggtgtggagggacggtgagcaccccnggaatggcagcctgctgcaagctgcaacttatttg

SEQ ID NO: 42645 - DNA, 71 bp, chicken (Gallus Gallus)
  misc_feature (36): n=a or g
gccggcgtgcacccagcgtgaggcagaaggcaagcncaccatccctgtcccgatgacaatgtccctgctgt

SEQ ID NO: 42646 - DNA, 71 bp, chicken (Gallus Gallus)
  misc_feature (36): n=c or t
gggcttgcccatcgcattcactcagccacttctttntgtagagttctgtggatctatttttgtatatataa

SEQ ID NO: 42647 - DNA, 71 bp, chicken (Gallus Gallus)
  misc_feature (36): n=c or t
aagaataagaacaagaaaaccagccccatttccttnctttctcttatcctaagcacatattcattcacatg

SEQ ID NO: 42648 - DNA, 71 bp, chicken (Gallus Gallus)
  misc_feature (36): n=c or t
cccatagcgtgtttagtagtgcaaacaatttgtaancttgtgctcctaatgcagcatgctcactaattgtt

SEQ ID NO: 42649 - DNA, 71 bp, chicken (Gallus Gallus)
  misc_feature (36): n=c or t
caaaactttttgaagatggcattctcctctttgtgntgtatctgcaaatgagccactccttggttttatta

SEQ ID NO: 42650 - DNA, 71 bp, chicken (Gallus Gallus)
  misc_feature (36): n=a or g
actcatgggaatgttagggtatcagaaaccagctcnaggatcccagatgttgtggcttgttttgctcacca

SEQ ID NO: 42651 - DNA, 71 bp, chicken (Gallus Gallus)
  misc_feature (36): n=g or t
gaataaactgtgtgtaggaagtgagcgctggctttnatttgacttaaccacatgtctgtgatcaggaaaga

SEQ ID NO: 42652 - DNA, 71 bp, chicken (Gallus Gallus)
  misc_feature (36): n=a or g
acccagcgacagtcctgcagctctccttgggattanggcagctactgttggaaaagcttcttggctgtgtg

SEQ ID NO: 42653 - DNA, 71 bp, chicken (Gallus Gallus)
  misc_feature (36): n=a or g
atctcagtgggcaccgtgcaactccacgctcaactnaattgcatcagtataaattaaagccctgtgtgggc

SEQ ID NO: 42654 - DNA, 71 bp, chicken (Gallus Gallus)
  misc_feature (36): n=g or t
gacaaacctttccttgaggtgtcgcacaagaaaggnctttactatgagattacatcaggacacaagtcact

SEQ ID NO: 42655 - DNA, 71 bp, chicken (Gallus Gallus)
  misc_feature (36): n=a or g
tggtctggctctaggtcagtgattcccaagccaganctgtgattctggtgaagtcatagcattttagacag

SEQ ID NO: 42656 - DNA, 71 bp, chicken (Gallus Gallus)
  misc_feature (36): n=c or t
aactatgacaactgctggaggcaacactacatttancctttttttagcatgctcaattactaactacaaat

SEQ ID NO: 42657 - DNA, 71 bp, chicken (Gallus Gallus)
  misc_feature (36): n=a or g
caaaatacatctgtgtaaacctgtgcacagaatctnaagtatgatgaggtaactgccaggtagtttcagca

SEQ ID NO: 42658 - DNA, 71 bp, chicken (Gallus Gallus)
  misc_feature (36): n=c or t
ctctacaggagggctttttcttacttgcattgaganagtctttataattcaagagatttttttactcagaa

SEQ ID NO: 42659 - DNA, 71 bp, chicken (Gallus Gallus)
  misc_feature (36): n=a or c
caatctccaggattcagaaagcaatgaattaggatncccaacaccatgttttgagatggtattttatacta

SEQ ID NO: 42660 - DNA, 71 bp, chicken (Gallus Gallus)
  misc_feature (36): n=c or t
gggtgaagcttttaggcatatgtgagagcttcttangaaagccacgaacaccacgaggtgtttggtttatt

SEQ ID NO: 42661 - DNA, 71 bp, chicken (Gallus Gallus)
  misc_feature (36): n=a or g
ggaaaagcaaatgatcaaaacacttatcacacagcnaaaagaagttatcgggcctgataaggtgtctgaat

SEQ ID NO: 42662 - DNA, 71 bp, chicken (Gallus Gallus)
  misc_feature (36): n=c or t
aaaaatcagagaaatgcaatgcctttattcccttgngttgtttaaagtttttctcatggcaccacacaatg

SEQ ID NO: 42663 - DNA, 71 bp, chicken (Gallus Gallus)
  misc_feature (36): n=c or t
aagtgagaccgacacaccaagcagcccctgctcacnaaattcactgctcgggcagcgatccttggaccagc

SEQ ID NO: 42664 - DNA, 71 bp, chicken (Gallus Gallus)
  misc_feature (36): n=c or t
gttaactctttgtgcatttggaataaaatcagaccnaactcactgagggtaaccctcccttcacagaactg

SEQ ID NO: 42665 - DNA, 71 bp, chicken (Gallus Gallus)
  misc_feature (36): n=c or t
gtgactctttatctcagcctttacatcttggctgcntttacaataacagatgtggcttttccttcccatca

SEQ ID NO: 42666 - DNA, 71 bp, chicken (Gallus Gallus)
  misc_feature (36): n=a or c
ttcaaagtgccagggaacttttgtttgtaactaaanacttttggctctttcagtaccttcaatatatacag

SEQ ID NO: 42667 - DNA, 71 bp, chicken (Gallus Gallus)
  misc_feature (36): n=a or g
attttccagaagaaaagtaacctacaaaaaacagtnattctgaaagtatctcaactcctctattctttgct

SEQ ID NO: 42668 - DNA, 71 bp, chicken (Gallus Gallus)
  misc_feature (36): n=c or t
aaggaataagatgctttatgtacttttttcccctcnccctagaaattacaaaaatcacctcatcctcacaa

SEQ ID NO: 42669 - DNA, 71 bp, chicken (Gallus Gallus)
  misc_feature (36): n=a or g
tactttgttgaatcattctctcagaatgaccttgcnatatctcagtgttgccattactgcatagcagttga

SEQ ID NO: 42670 - DNA, 71 bp, chicken (Gallus Gallus)
  misc_feature (36): n=a or g
gttgacttgcttgagcaaattaggtagttctgggtnctctgccctgtgttgatattcaggaaggcacaaca

SEQ ID NO: 42671 - DNA, 71 bp, chicken (Gallus Gallus)
  misc_feature (36): n=a or g
gaagaagctgtggtgacatttaaagccacgcacacnggtttgccaacatgtatcagagtgaatctccagtg

SEQ ID NO: 42672 - DNA, 71 bp, chicken (Gallus Gallus)
  misc_feature (36): n=a or g
ttaccagagatcttaaaataccattatccaaccttncacagagacaccaagccctccatgacctgcagaaa

SEQ ID NO: 42673 - DNA, 71 bp, chicken (Gallus Gallus)
  misc_feature (36): n=a or g
ccattttcacttgtttcttctacatcctcctctgancgattcagggtctgcttgttggctggaactgagtt

SEQ ID NO: 42674 - DNA, 71 bp, chicken (Gallus Gallus)
  misc_feature (36): n=a or c
caactactgcaatgagtaaagtgggacagaatagantgattagtccaaagcagtttaaggtgctctgagct

SEQ ID NO: 42675 - DNA, 71 bp, chicken (Gallus Gallus)
  misc_feature (36): n=a or g
cagtgtatgtgaagcagaagttttgcaactgctttnaattccctgacacataatgcagatttgcaaagtca

SEQ ID NO: 42676 - DNA, 71 bp, chicken (Gallus Gallus)
  misc_feature (36): n=a or g
tcagttcagcactgacgttccttttgttctcaaaanataagttcagatgccattattttgtcacagtccca

SEQ ID NO: 42677 - DNA, 71 bp, chicken (Gallus Gallus)
  misc_feature (36): n=c or t
gggtgcccttctctgaaggacagcgcttccctcttngcattatttctgccagttcttacaaattctgccca

SEQ ID NO: 42678 - DNA, 71 bp, chicken (Gallus Gallus)
  misc_feature (36): n=a or g
tgctgatttatagacttaatcctattaagactgtcnagatttgtaaatggacaaccactaatgagatttgt

SEQ ID NO: 42679 - DNA, 71 bp, chicken (Gallus Gallus)
  misc_feature (36): n=c or t
tcatagtttttatctcgtggattcctgcaaaaatangttggccctctgatgttggcctctccgtacaattc

SEQ ID NO: 42680 - DNA, 71 bp, chicken (Gallus Gallus)
  misc_feature (36): n=c or t
tattaatttttgtgtattttaagcatgtgcagactngcacttaatttatagaatctagctttagcactcaa

SEQ ID NO: 42681 - DNA, 71 bp, chicken (Gallus Gallus)
  misc_feature (36): n=c or t
tgttggtttcatcacaacactatcagaagcttgttnccttagtgagcaatttgcttttgagaagtaacgct

SEQ ID NO: 42682 - DNA, 71 bp, chicken (Gallus Gallus)
  misc_feature (36): n=a or g
ttcttaaatatcttcatcttctcaaagagctcttgngaaaatactgtgttctaatctgtacttcagctgta

SEQ ID NO: 42683 - DNA, 71 bp, chicken (Gallus Gallus)
  misc_feature (36): n=a or g
ccaggcatctggagcattaatctaggctgatttccncttctggcatgcataaacattgcttttcaaaaact

SEQ ID NO: 42684 - DNA, 71 bp, chicken (Gallus Gallus)
  misc_feature (36): n=c or t
ttgaggcactattcagaatcaacattataattaatnctatggatacttctttgggggacaaagtatataaa

SEQ ID NO: 42685 - DNA, 71 bp, chicken (Gallus Gallus)
  misc_feature (36): n=a or g
aggtcagtatctaatgagtcccacatacactgctgncagaggaaaagaggacctcacaagttaagtatata

SEQ ID NO: 42686 - DNA, 71 bp, chicken (Gallus Gallus)
  misc_feature (36): n=c or t
ctccaggttcgtctgttacttccccctcttaaaaangtgtggactagatattatcaaatgaggtgtttaca

SEQ ID NO: 42687 - DNA, 71 bp, chicken (Gallus Gallus)
  misc_feature (36): n=a or g
catcttagtcctcttactcaaccagaagaaattacntcacagcgctactaagtgcgtgtggagtgggtctg

SEQ ID NO: 42688 - DNA, 71 bp, chicken (Gallus Gallus)
  misc_feature (36): n=c or t
aaaatcagaattgctcttatgtatcaacagctatgnctccaaaaaattccccttgcgcctcttctggcatc

SEQ ID NO: 42689 - DNA, 71 bp, chicken (Gallus Gallus)
  misc_feature (36): n=c or t
attactccaaaatagcttccccacagatagttattngggaataagcatgtctttttaatgattggtacttg

SEQ ID NO: 42690 - DNA, 71 bp, chicken (Gallus Gallus)
  misc_feature (36): n=c or t
ctgcccatgcttggcttcctgtagctttgccacatntcagcacttcaggctgaaattttgtttcttgggtg

SEQ ID NO: 42691 - DNA, 71 bp, chicken (Gallus Gallus)
  misc_feature (36): n=a or g
aaatatatatatacgttcatgatttctatcctacangaaacctgcataacattcatcagcaattttttctt

SEQ ID NO: 42692 - DNA, 71 bp, chicken (Gallus Gallus)
  misc_feature (36): n=a or g
actgaaaatgaagctagtagatatggcaggtttttntgctgtatgctggagactgtgactagatggcacag

SEQ ID NO: 42693 - DNA, 71 bp, chicken (Gallus Gallus)
  misc_feature (36): n=c or t
agtgggacaactcctagaggtgtctttgaaagcatncctcactccaacaagcacagcacatcggtgttgtt

SEQ ID NO: 42694 - DNA, 71 bp, chicken (Gallus Gallus)
  misc_feature (36): n=g or t
ttcctatctttggagatttctgatactatttgcaantatacaccacataccctgaattacacagctgaatt

SEQ ID NO: 42695 - DNA, 71 bp, chicken (Gallus Gallus)
  misc_feature (36): n=c or t
atgactgcttagctattacatgtggactttttctantttatgtagaactctgaagtacagaagggatacag

SEQ ID NO: 42696 - DNA, 71 bp, chicken (Gallus Gallus)
  misc_feature (36): n=c or t
tgtgaccaacacatgtgaagtgacagagaaggccangatcccacatagtcaaatgtgtcttgcttgtttgc

SEQ ID NO: 42697 - DNA, 71 bp, chicken (Gallus Gallus)
  misc_feature (36): n=c or t
aatacttattttacatatgtcattctcagcaagttngggaaggtagaaatccaagaaatagagctgctgct

SEQ ID NO: 42698 - DNA, 71 bp, chicken (Gallus Gallus)
  misc_feature (36): n=g or t
aaggcaggggagggggaaaatgaacagctctcctanagagtgggagagagagattcattgacagttttaaa

SEQ ID NO: 42699 - DNA, 71 bp, chicken (Gallus Gallus)
  misc_feature (36): n=a or g
agtttgggcagtaacaactacctccatttatgattnctgacctactcttgtagtttatgactggatctcta

SEQ ID NO: 42700 - DNA, 71 bp, chicken (Gallus Gallus)
  misc_feature (36): n=a or g
caaaaacaactcatgcagatggtacatgtggtaacncatcagctactctgaaattgaatgatggaaatagg

SEQ ID NO: 42701 - DNA, 71 bp, chicken (Gallus Gallus)
  misc_feature (36): n=a or g
gattctgttgtataacttgggaaagcgctcctcagngagtcctcggttgcctgtgtcttaaatgttttgct

SEQ ID NO: 42702 - DNA, 71 bp, chicken (Gallus Gallus)
  misc_feature (36): n=a or c
tagattctcattttgagaatgcccagggagtggatncccagatctccaactcagctgggtttggctttgca

SEQ ID NO: 42703 - DNA, 71 bp, chicken (Gallus Gallus)
  misc_feature (36): n=c or t
gaagatggttacagaaagcaaaaggtttatgagacngatgaattcattcattatttattaaactactatca

SEQ ID NO: 42704 - DNA, 71 bp, chicken (Gallus Gallus)
  misc_feature (36): n=a or g
gaggggtgcctggatgtcagcgactttggttgccanctctcgtcctgccaccgcactgacccgctgcaccg

SEQ ID NO: 42705 - DNA, 71 bp, chicken (Gallus Gallus)
  misc_feature (36): n=a or c
tgtgaagaggaaaaatgtgtccttgttttgcatgtnctcttgcttaatcattacatttctcatataattct

SEQ ID NO: 42706 - DNA, 71 bp, chicken (Gallus Gallus)
  misc_feature (36): n=a or g
aagtatcctgtgctgtacctgatgtggttactgttntaaagctgtccgtgttaatgcagtgacctgaaatg

SEQ ID NO: 42707 - DNA, 71 bp, chicken (Gallus Gallus)
  misc_feature (36): n=a or g
agaggaaaagccttataaacaccaaactggaactgntctgcgggtgccactgataaacggagtcaccaagc

SEQ ID NO: 42708 - DNA, 71 bp, chicken (Gallus Gallus)
  misc_feature (36): n=a or g
attacatggttactagctacaagctaaggctttctnttgtgttaattctataatgttacacagcaattgca

SEQ ID NO: 42709 - DNA, 71 bp, chicken (Gallus Gallus)
  misc_feature (36): n=c or t
gtgggcttctcttggttttggaatttgggactgcancatctcccaaccccatgtgtgccttcgcagcctga

SEQ ID NO: 42710 - DNA, 71 bp, chicken (Gallus Gallus)
  misc_feature (36): n=a or c
aatgaagaattgaatgacactttcaaagcatctaanagatatgactgtaagctatgatgtatcttaaagaa

SEQ ID NO: 42711 - DNA, 71 bp, chicken (Gallus Gallus)
  misc_feature (36): n=a or g
tgtaggtagaggagttgggtgcatgttgattacatnagtatacaggtgcacccatgcatttcttcaccatg

SEQ ID NO: 42712 - DNA, 71 bp, chicken (Gallus Gallus)
  misc_feature (36): n=c or t
acagttgtgagagcatgaaagcaaccactggaacanagactgctacaagagaacttgttgtttttgcactg

SEQ ID NO: 42713 - DNA, 71 bp, chicken (Gallus Gallus)
  misc_feature (36): n=a or g
cttgtatagacagctagcccagaaatgaaatgtaancctttgaacagtctaatgaaatacgcatacctttg

SEQ ID NO: 42714 - DNA, 71 bp, chicken (Gallus Gallus)
  misc_feature (36): n=a or g
ctctgaatttaggggaagaatctatatccagaatgnagagtgagaatcattcagacatgtcactgagaatc

SEQ ID NO: 42715 - DNA, 71 bp, chicken (Gallus Gallus)
  misc_feature (36): n=a or c
cttccatcacagggaatggagacagtggtgccgtgnagctaggtctctgtttgctttgacaacaaattgca

SEQ ID NO: 42716 - DNA, 71 bp, chicken (Gallus Gallus)
  misc_feature (36): n=a or g
gccaacactgggccaaacacacagcatcctcctcantccataaagacgtactgtgggattggcacttactg

SEQ ID NO: 42717 - DNA, 71 bp, chicken (Gallus Gallus)
  misc_feature (36): n=c or t
gctgtcagggtgtctttctaacgagcagtctattanggtcaacagcaggaacaatctgagaggcagagaaa

SEQ ID NO: 42718 - DNA, 71 bp, chicken (Gallus Gallus)
  misc_feature (36): n=g or t
tcagagatcagagccaaatcctccatgtacctttancaggaatactgccagcaggcttgctgtggctgtgt

SEQ ID NO: 42719 - DNA, 71 bp, chicken (Gallus Gallus)
  misc_feature (36): n=c or t
ggtagcttcccagtcacagcttggccctttgaggcntcctgtgtgagacagggtttactacactgcagtgc

SEQ ID NO: 42720 - DNA, 71 bp, chicken (Gallus Gallus)
  misc_feature (36): n=a or g
ttcaaaagcattagtccttatttcagtgttttcaantcttatcttccaaacttcccctataacacatttct

SEQ ID NO: 42721 - DNA, 71 bp, chicken (Gallus Gallus)
  misc_feature (36): n=c or t
acttttgttctacatttctgtattgtttccactatngtggttttattctttagctgctggggccagaatca

SEQ ID NO: 42722 - DNA, 71 bp, chicken (Gallus Gallus)
  misc_feature (36): n=g or t
tttgaatgtcacatcagatttatgaaaaagcatgancccctgactgtttgagggaaggaacaagaaataac

SEQ ID NO: 42723 - DNA, 71 bp, chicken (Gallus Gallus)
  misc_feature (36): n=c or t
taacgctaattattgctgactagggtgagcttttgnttacaaaacaagatttgtatgatcatttctagctt

SEQ ID NO: 42724 - DNA, 71 bp, chicken (Gallus Gallus)
  misc_feature (36): n=a or g
gaacatagaaattgctttcaaaactaataaaggttnactaaaaacattacagcaaatatttcccttttctc

SEQ ID NO: 42725 - DNA, 71 bp, chicken (Gallus Gallus)
  misc_feature (36): n=c or t
gtgctaaaagagcatctcctgcactacatttatagntcggccttaggtgtacaacaggggttttattttat

SEQ ID NO: 42726 - DNA, 71 bp, chicken (Gallus Gallus)
  misc_feature (36): n=a or c
ctttggaaagggtgttctggcacttagtgcttcagnacctataatcacattgttgttgccaactctgaggt

SEQ ID NO: 42727 - DNA, 71 bp, chicken (Gallus Gallus)
  misc_feature (36): n=a or g
ctgcccagtgtgggacattttgcattagactcagangagtgaagggagtagagtttcctgccccagttttg

SEQ ID NO: 42728 - DNA, 71 bp, chicken (Gallus Gallus)
  misc_feature (36): n=a or g
tagctgctggatgaaatgtagttctgtttgcatcanctttatgcctactgtaattgccctcagttgcagtt

SEQ ID NO: 42729 - DNA, 71 bp, chicken (Gallus Gallus)
  misc_feature (36): n=a or c
aaaccagggcggtgagccgggccccgcagtgccctncggagccgcagctgtccgtgccgatccgcgcagcc

SEQ ID NO: 42730 - DNA, 71 bp, chicken (Gallus Gallus)
  misc_feature (36): n=a or g
caaggatggagggggacagaatggacactgcagtgngagatctttgccctctgctcattcctacggaagag

SEQ ID NO: 42731 - DNA, 71 bp, chicken (Gallus Gallus)
  misc_feature (36): n=c or t
gttaatttcaaattatgttatggtgaggtgcaagcngttcatagcaataaaaggatacctttgtggaaaac

SEQ ID NO: 42732 - DNA, 71 bp, chicken (Gallus Gallus)
  misc_feature (36): n=c or t
accataccctgcaagtaggatagaacacatctgaanggcaaatggatggccaacgcaaagagtattttgtg

SEQ ID NO: 42733 - DNA, 71 bp, chicken (Gallus Gallus)
  misc_feature (36): n=c or t
caagtctgaaaaatcatgccctattgcacattagtnccttttctctcaaaggagcacactgacatgcaaat

SEQ ID NO: 42734 - DNA, 71 bp, chicken (Gallus Gallus)
  misc_feature (36): n=a or g
tatgtgaaaaaaaatcagtacaggcaacatttttancagtgatttccacaaaagaccttttgaagtgaaat

SEQ ID NO: 42735 - DNA, 71 bp, chicken (Gallus Gallus)
  misc_feature (36): n=a or c
atggactcatggatcccactgctctatgtaaaaacnaaacatacacggctctcaggacagggtattttatg

SEQ ID NO: 42736 - DNA, 71 bp, chicken (Gallus Gallus)
  misc_feature (36): n=c or t
ttcacttgtttgtcttctccacaggaaaagaggtanggacttcttgcacttactatcacacctcgtacagt

SEQ ID NO: 42737 - DNA, 71 bp, chicken (Gallus Gallus)
  misc_feature (36): n=c or t
agctagtatcaaggtgagtagtaagtaacttgttgngcagttcagttgtatgatagatttgtgatggtatc

SEQ ID NO: 42738 - DNA, 71 bp, chicken (Gallus Gallus)
  misc_feature (36): n=c or t
caataatcttccaccgtggttgcttcatcaaatatnctggcatcttcttctcctgttagtaaacagaagag

SEQ ID NO: 42739 - DNA, 71 bp, chicken (Gallus Gallus)
  misc_feature (36): n=g or t
taaagaaaatgcttcatttcaaattgctaagcctanctgaggaggctggctgaccagaagtgaccattgtg

SEQ ID NO: 42740 - DNA, 71 bp, chicken (Gallus Gallus)
  misc_feature (36): n=c or t
tttcaaaacagaatctcttttggtatattcagagangcaaaagtctctaggagaactaccttttgtctttt

SEQ ID NO: 42741 - DNA, 71 bp, chicken (Gallus Gallus)
  misc_feature (36): n=c or t
gaaaaggcaagagaaatttagtaaagtgcttagctncccattaaaaagaggataagagagggagtttttca

SEQ ID NO: 42742 - DNA, 71 bp, chicken (Gallus Gallus)
  misc_feature (36): n=a or c
cacgaggtcaccactgacaacaaactgctgcgcatnttcaagaacggcaacgtgctctacagcatcaggtg

SEQ ID NO: 42743 - DNA, 71 bp, chicken (Gallus Gallus)
  misc_feature (36): n=c or t
cagaagcctttgatatccttccaataaagcttgacnacattcaaagcctcaaattctcttatttgaaaacc

SEQ ID NO: 42744 - DNA, 71 bp, chicken (Gallus Gallus)
  misc_feature (36): n=a or g
cacaaaggactcaggatgaaataatgtgcttgagcncccccatctctaaattgctcaggttatcttccaac

SEQ ID NO: 42745 - DNA, 71 bp, chicken (Gallus Gallus)
  misc_feature (36): n=a or g
ctatcctagtgactcagaacacctgctgggtcatcncatagtcattgcaatatactgcactaagtttcagg

SEQ ID NO: 42746 - DNA, 71 bp, chicken (Gallus Gallus)
  misc_feature (36): n=a or g
tttatgaatgagacaaaaggaagtgtgagaatgaancggttggtggtcattgtaaaggattatatctggtg

SEQ ID NO: 42747 - DNA, 71 bp, chicken (Gallus Gallus)
  misc_feature (36): n=g or t
gacatctttcattgtgtactgcatctgcctggcatngtgttcacttttcccagagcagcccatataatgct

SEQ ID NO: 42748 - DNA, 71 bp, chicken (Gallus Gallus)
  misc_feature (36): n=a or g
ataaatttctagtataaaaaaaatcacctctctacntatttgatactttaattgataagctcattaatccc

SEQ ID NO: 42749 - DNA, 71 bp, chicken (Gallus Gallus)
  misc_feature (36): n=a or g
aggtaaagaattatgtgtgacaaaggtttgtctatncctggtgcattaaaaatagatggtttcaaaatgtg

SEQ ID NO: 42750 - DNA, 71 bp, chicken (Gallus Gallus)
  misc_feature (36): n=c or t
gtctagcatactggacacaaggcttgtgcaagaaanagattattttggttcatgtgatgtttcaaaataat

SEQ ID NO: 42751 - DNA, 71 bp, chicken (Gallus Gallus)
  misc_feature (36): n=c or t
ttcaaaaatagacagttttaaccttaacaagcagangtgtatttgctgtgccagatatcccatgccaaatt

SEQ ID NO: 42752 - DNA, 71 bp, chicken (Gallus Gallus)
  misc_feature (36): n=a or g
gtctccaaaatattttgtacagctttttcattaagncaaaatgtcaggggatagtattatttaaaccaagc

SEQ ID NO: 42753 - DNA, 71 bp, chicken (Gallus Gallus)
  misc_feature (36): n=c or t
tgattctgtttgactttaaaaatagagtatgacagnaaagagcacagctacgtcttttagttaataagcta

SEQ ID NO: 42754 - DNA, 71 bp, chicken (Gallus Gallus)
  misc_feature (36): n=a or g
tacatctgcatagtttatccttttaggtgtttgaancccagaaaatgcaggacaatttccattttagttct

SEQ ID NO: 42755 - DNA, 71 bp, chicken (Gallus Gallus)
  misc_feature (36): n=a or g
taaaatgagtattctagtgctttacctgtcagctcnaagtacttcctgggcattaatattcagataaatag

SEQ ID NO: 42756 - DNA, 71 bp, chicken (Gallus Gallus)
  misc_feature (36): n=a or g
aaaataaaagaaaaaaacccagcaaatctttgtacncaattgacactgcatctgcctgatctctttgtctg

SEQ ID NO: 42757 - DNA, 71 bp, chicken (Gallus Gallus)
  misc_feature (36): n=c or t
acctttcgctgcaaagaggctgtaaagcaaaaattntgaatgagatttcatagcaattttggaaaggatat

SEQ ID NO: 42758 - DNA, 71 bp, chicken (Gallus Gallus)
  misc_feature (36): n=a or c
aattgggctagaacacatttgagtgaaaattaaacngcagtattgacaagatctaagtacattttttaaat

SEQ ID NO: 42759 - DNA, 71 bp, chicken (Gallus Gallus)
  misc_feature (36): n=a or g
tcagtcttcattaaagaatctatgtttcttccaagnagcaggtatgtcaactgtggatgcactacatttaa

SEQ ID NO: 42760 - DNA, 71 bp, chicken (Gallus Gallus)
  misc_feature (36): n=a or g
aagaattgtcttgttcactctgatattgcagaaacntgcatattttatagttttggcatgcccataattta

SEQ ID NO: 42761 - DNA, 71 bp, chicken (Gallus Gallus)
  misc_feature (36): n=c or t
acacacttcagaacatgtatgtgatttttgcacttntgaaattgtgttttgaattgccctaagtgtccaat

SEQ ID NO: 42762 - DNA, 71 bp, chicken (Gallus Gallus)
  misc_feature (36): n=a or g
tctgtgcattagaaattgtcagaaagagacaaagancattttgaaatacaacaaaatgttgtgagctaaca

SEQ ID NO: 42763 - DNA, 71 bp, chicken (Gallus Gallus)
  misc_feature (36): n=a or g
ttgctagatatgggctgaactgtaaagctggaagcnttgagtgctgcttggtctgagttgaggagcactgg

SEQ ID NO: 42764 - DNA, 71 bp, chicken (Gallus Gallus)
  misc_feature (36): n=c or t
ccaggtggcccatggggcaaacgttttccagccacnggaagtcagattcaaaagtatgcacaaactgcaca

SEQ ID NO: 42765 - DNA, 71 bp, chicken (Gallus Gallus)
  misc_feature (36): n=c or t
atgtcaattagagatgatgcagtttaaggatacttncagctacatttgcagttagatattttaccattata

SEQ ID NO: 42766 - DNA, 71 bp, chicken (Gallus Gallus)
  misc_feature (36): n=a or c
cctgaactgcgcattccacattttgcagtagcagcngtaactgaaatggcagactcaaatcattacctagc

SEQ ID NO: 42767 - DNA, 71 bp, chicken (Gallus Gallus)
  misc_feature (36): n=c or t
ttcatcaatttgtgctcactgtatacatactcaaanaccttttcatttgctattatatagattaagctttg

SEQ ID NO: 42768 - DNA, 71 bp, chicken (Gallus Gallus)
  misc_feature (36): n=c or t
ttatgaatatttacaagactttgcaataaggactangttatgaatttaatgaggtagagaaatgcagtgaa

SEQ ID NO: 42769 - DNA, 71 bp, chicken (Gallus Gallus)
  misc_feature (36): n=a or c
atacatcatgctacagaatgcagggtgagggcctcntttgcttgtctgttccgttcagtcattgcagctgg

SEQ ID NO: 42770 - DNA, 71 bp, chicken (Gallus Gallus)
  misc_feature (36): n=c or t
tacaagctttgagctagaaaacaatctcatgaaaanacatcaataagtccctattaaagagaagagtagtc

SEQ ID NO: 42771 - DNA, 71 bp, chicken (Gallus Gallus)
  misc_feature (36): n=c or t
acaaccaccatcaaattgacagcaagccatttccanacagaattgtttttctccatttgcttaagactttt

SEQ ID NO: 42772 - DNA, 71 bp, chicken (Gallus Gallus)
  misc_feature (36): n=c or t
actgaaagccagtatgtcttttggccttcctcatantaatggtaagactttactactgcagttttgtagaa

SEQ ID NO: 42773 - DNA, 71 bp, chicken (Gallus Gallus)
  misc_feature (36): n=a or g
ttgcttgaaccctcctggccagcagttacacctggnacctagcaggaactacatttttcagcaagaaagtc

SEQ ID NO: 42774 - DNA, 71 bp, chicken (Gallus Gallus)
  misc_feature (36): n=c or t
aatggatctctggtgtgaagtgctactgatggctgntggttattcatgcttattttgtcttctgatttgtg

SEQ ID NO: 42775 - DNA, 71 bp, chicken (Gallus Gallus)
  misc_feature (36): n=a or c
aaaacagacaaaaagtagaaggttcaggggccaaanaagtcccctcatgaacagtcaagtcccactgacca

SEQ ID NO: 42776 - DNA, 71 bp, chicken (Gallus Gallus)
  misc_feature (36): n=c or t
tttctttggacatttatagccatacttctgtctgtncattcatttgcaatttgcttgtagcacagcaattc

SEQ ID NO: 42777 - DNA, 71 bp, chicken (Gallus Gallus)
  misc_feature (36): n=a or g
acgtattttattcttgtgatctagtacatctaatanaaaaaataggcaagtgtttagttattacatgaaat

SEQ ID NO: 42778 - DNA, 71 bp, chicken (Gallus Gallus)
  misc_feature (36): n=c or t
atttattttgttcagctttcacacaatgaacagcangctgggaatgagcctgttaccaggtagacatctgc

SEQ ID NO: 42779 - DNA, 71 bp, chicken (Gallus Gallus)
  misc_feature (36): n=a or g
aaagctttaaagtaatacagaaaattgtgttggagncttaattttagcaaaaaacaatttttacccactac

SEQ ID NO: 42780 - DNA, 71 bp, chicken (Gallus Gallus)
  misc_feature (36): n=a or c
tcagccatccagaaaaagcactcgggaaggagctancatcggagccctggggcttataagccaaactgtgc

SEQ ID NO: 42781 - DNA, 71 bp, chicken (Gallus Gallus)
  misc_feature (36): n=a or g
tctcctccccaaccctgctggacaaaagcacagacnggatcaacctgaagcctcccagcccagcacaccct

SEQ ID NO: 42782 - DNA, 71 bp, chicken (Gallus Gallus)
  misc_feature (36): n=c or t
tgaactaagttctgacacttcctcaaaatattctcntagccttcagtagctcgtatcataaggccactctc

SEQ ID NO: 42783 - DNA, 71 bp, chicken (Gallus Gallus)
  misc_feature (36): n=a or g
gagttttcacatttcaattctattttcctcccctgnagttcaagattcatttctgatgggtagaaaaagaa

SEQ ID NO: 42784 - DNA, 71 bp, chicken (Gallus Gallus)
  misc_feature (36): n=c or t
agatttactaatatcagaaaagagctcaggtccagnttcctcttttctcgtatttccaggtgcagcttaca

SEQ ID NO: 42785 - DNA, 71 bp, chicken (Gallus Gallus)
  misc_feature (36): n=c or t
gtagtttctcagttacccagctaagccagttttcangattcttctccctatagtttaagagaatggtgtta

SEQ ID NO: 42786 - DNA, 71 bp, chicken (Gallus Gallus)
  misc_feature (36): n=c or t
ctgttgcgtttatgatagcaaacactgatagaaatnttgtctgtgataaactgtgcaagctaagggaagcc

SEQ ID NO: 42787 - DNA, 71 bp, chicken (Gallus Gallus)
  misc_feature (36): n=c or t
gaagttcttattttgaccttctaagaagcttttacngtcccactgagacaaactcttgttttcttttaacc

SEQ ID NO: 42788 - DNA, 71 bp, chicken (Gallus Gallus)
  misc_feature (36): n=c or t
ggcaatatgtgaaaatgcagacatatccatgtatcnacaaaagaaagtattaagcagttccttgtcttaaa

SEQ ID NO: 42789 - DNA, 71 bp, chicken (Gallus Gallus)
  misc_feature (36): n=c or t
actatttattatattgatccaatgtaaacaaactgngtgatatctcaagagatgaaacataaccttttatt

SEQ ID NO: 42790 - DNA, 71 bp, chicken (Gallus Gallus)
  misc_feature (36): n=a or g
gcttacagtatgtaaggccatttcttaatctccttnactgcgtgttcaagcacagcaccagctttttgtat

SEQ ID NO: 42791 - DNA, 71 bp, chicken (Gallus Gallus)
  misc_feature (36): n=a or g
tgctttcagatgttcattttataccatgtggagagnaaggaaacaaaataattcaatgtaaggaaccctgg

SEQ ID NO: 42792 - DNA, 71 bp, chicken (Gallus Gallus)
  misc_feature (36): n=a or g
gtttcagtaccctcagcctgccttttagttgtgtanttgaatcacaacccattgcatcgcttacgtttaag

SEQ ID NO: 42793 - DNA, 71 bp, chicken (Gallus Gallus)
  misc_feature (36): n=c or t
aatcaatgaaaatgcaaatatggcataagaaagtgnaactttatcttagactttcaacactgcacttcctt

SEQ ID NO: 42794 - DNA, 71 bp, chicken (Gallus Gallus)
  misc_feature (36): n=a or g
atactactgcaaaggaaaatggtaactgaaaaattnctgagttatttaaaacttcttgtaggattcccact

SEQ ID NO: 42795 - DNA, 71 bp, chicken (Gallus Gallus)
  misc_feature (36): n=a or g
cgcttaacagtaactgctgcatagtttaagatgacntccttgaggccaggtgctgcatttggcttgaccac

SEQ ID NO: 42796 - DNA, 71 bp, chicken (Gallus Gallus)
  misc_feature (36): n=g or t
tattccagacagtacagtctgtaggtagggtcaggngcaaattaatacagtacctacactgcagtgtatgg

SEQ ID NO: 42797 - DNA, 71 bp, chicken (Gallus Gallus)
  misc_feature (36): n=a or g
cagcatagctactgaaaagagctccaagctcactcnggacacagtctaccacagacagatcaaagtaccta

SEQ ID NO: 42798 - DNA, 71 bp, chicken (Gallus Gallus)
  misc_feature (36): n=a or g
ctagtttctgagttagatcatagttcaggtaatgtncaacctgaaaaccagactaagtagttaattaaaat

SEQ ID NO: 42799 - DNA, 71 bp, chicken (Gallus Gallus)
  misc_feature (36): n=c or t
ctccaggggaacggtgtggcagtgaactctagcacngtacccacagctgtggtttctgcagcacatatcca

SEQ ID NO: 42800 - DNA, 71 bp, chicken (Gallus Gallus)
  misc_feature (36): n=a or g
tacatttttcttccctgtaaactgaccatcactganaattaaagattttggaatcccaatgaaaaacagta

SEQ ID NO: 42801 - DNA, 71 bp, chicken (Gallus Gallus)
  misc_feature (36): n=c or t
gtattattatgctttactactctaatgctcaatcantggaaggaattacaacagcacttgcttctgtatct

SEQ ID NO: 42802 - DNA, 71 bp, chicken (Gallus Gallus)
  misc_feature (36): n=a or g
tccagcatttcttgtggattgtaaggagagtaacanaagtgaatttaaaacaagtgaactgacatttaatg

SEQ ID NO: 42803 - DNA, 71 bp, chicken (Gallus Gallus)
  misc_feature (36): n=g or t
tctcttctgtgttgttttatgatggtacagaagatngactcaaagcataatgctaacagctaacgaagtct

SEQ ID NO: 42804 - DNA, 71 bp, chicken (Gallus Gallus)
  misc_feature (36): n=c or t
aaatgattaattgctaatgacaatttatccaatctngaaaattagctgtcaagccatcaagtcataccgaa

SEQ ID NO: 42805 - DNA, 71 bp, chicken (Gallus Gallus)
  misc_feature (36): n=a or g
ctgcatagcatctactgaattaggaagaaagttgcnggaagtgatactggcacattgacattcattcctct

SEQ ID NO: 42806 - DNA, 71 bp, chicken (Gallus Gallus)
  misc_feature (36): n=c or t
aataaacatatggtaatggcttaggaaatcagcatntcccttctgcactcagtgccagtgagtgaatagta

SEQ ID NO: 42807 - DNA, 71 bp, chicken (Gallus Gallus)
  misc_feature (36): n=g or t
tagccctgcatcctttctccaaacagcatatggcantgatggataaactcaattaaagcttgagcattagg

SEQ ID NO: 42808 - DNA, 71 bp, chicken (Gallus Gallus)
  misc_feature (36): n=c or t
tttccttatcattttttgcttccatacttgagaaanaagtttcagcagatgcttcagagactgaagcaagt

SEQ ID NO: 42809 - DNA, 71 bp, chicken (Gallus Gallus)
  misc_feature (36): n=a or c
tacttgtgccaaatatttatttatgaaaaattctgnatagtcttccaatgccttctgtatactttctcatc

SEQ ID NO: 42810 - DNA, 71 bp, chicken (Gallus Gallus)
  misc_feature (36): n=a or g
cccatcactaccaacacatggaaaaagaaggtggcngtttcagagccatcatccaaacacattcttcccct

SEQ ID NO: 42811 - DNA, 71 bp, chicken (Gallus Gallus)
  misc_feature (36): n=c or t
atactcagttctatattcagatatggttatctttangtagcccaaaacaagctatgcaatgtactaaaaat

SEQ ID NO: 42812 - DNA, 71 bp, chicken (Gallus Gallus)
  misc_feature (36): n=c or t
ttgaatgacatttattaaggattcaagaataaatangtttaattccactgtcaagatgtatccaattcagt

SEQ ID NO: 42813 - DNA, 71 bp, chicken (Gallus Gallus)
  misc_feature (36): n=c or t
tatgtttaaagagtattgagcttgcaccactgtgcnagaagagcaattcagtaaattgacatgcacagaat

SEQ ID NO: 42814 - DNA, 71 bp, chicken (Gallus Gallus)
  misc_feature (36): n=a or c
catttcacaaaaacaggtgaaaatatagcagaactntgtgtcaggctgcagccttaaaggatataaagcct

SEQ ID NO: 42815 - DNA, 71 bp, chicken (Gallus Gallus)
  misc_feature (36): n=g or t
aaacgcatgctgctgaactgaactcaggaatgctgntgtctgcaattgtagtgatagatctatggtcagtg

SEQ ID NO: 42816 - DNA, 71 bp, chicken (Gallus Gallus)
  misc_feature (36): n=c or t
gcatgctcacttaatgctcagctttgtcatgaaatntgaaaagttttcacttcccctaaaaataatttgtg

SEQ ID NO: 42817 - DNA, 71 bp, chicken (Gallus Gallus)
  misc_feature (36): n=a or g
ctttagaagcagaaagcaggctctgacacagcccanctgatgtaacgcaatcagttgctaaaaagacttgg

SEQ ID NO: 42818 - DNA, 71 bp, chicken (Gallus Gallus)
  misc_feature (36): n=a or g
gataaaaatgttgcctagataaaaagacagaaaagnagctttcttcaaattgaagttgctagtttgagtta

SEQ ID NO: 42819 - DNA, 71 bp, chicken (Gallus Gallus)
  misc_feature (36): n=c or t
caattaacatttcctggcacgtatacatggtgtatntgattgacaggaatacagaaatacttgtagtagtg

SEQ ID NO: 42820 - DNA, 71 bp, chicken (Gallus Gallus)
  misc_feature (36): n=a or g
attgaatttcctttattcagcactgaacttcacttncattttcctagaatctatgaaaaagtggaacttct

SEQ ID NO: 42821 - DNA, 71 bp, chicken (Gallus Gallus)
  misc_feature (36): n=c or t
gcagcagcccaggctgtgcctttctcaccatcagancacacattctggcttctcttgagacctccagtggg

SEQ ID NO: 42822 - DNA, 71 bp, chicken (Gallus Gallus)
  misc_feature (36): n=c or t
gtattccccattctgccacaaagttgacagcaggangtatggcttagcttacagagttttttgctcataag

SEQ ID NO: 42823 - DNA, 71 bp, chicken (Gallus Gallus)
  misc_feature (36): n=c or t
tttatgcagaaggatattcttgcctaaaaatcctgntctctttttaaataaatctaccatataacacaatt

SEQ ID NO: 42824 - DNA, 71 bp, chicken (Gallus Gallus)
  misc_feature (36): n=c or t
tttgtctgaattgttattggagacttctgaccagangactgtcaagttcctggttatctcatttgttaaac

SEQ ID NO: 42825 - DNA, 71 bp, chicken (Gallus Gallus)
  misc_feature (36): n=c or t
cttggaaaaaaaacagattacagggagaaataggtnttagagaaaagtccaactcatctggaagtagaagt

SEQ ID NO: 42826 - DNA, 71 bp, chicken (Gallus Gallus)
  misc_feature (36): n=a or g
ttgagtgtggacttcagggtatgctcttggtctttntattttgccttagtttaggtacccaagtcttttca

SEQ ID NO: 42827 - DNA, 71 bp, chicken (Gallus Gallus)
  misc_feature (36): n=c or t
aagttacatgaggtttcaagggctttctgtacaganggctccaataacctgaatatgggcaagaatatgga

SEQ ID NO: 42828 - DNA, 71 bp, chicken (Gallus Gallus)
  misc_feature (36): n=a or g
cttcctatggcaatatttgaggatgagaacttccanaaagagctcagaattcaggtccatgattattgcac

SEQ ID NO: 42829 - DNA, 71 bp, chicken (Gallus Gallus)
  misc_feature (36): n=a or g
gaaaacacagttactgtgacttggagctggtaaatntggaagacaggcagccaagctggcaaatattgact

SEQ ID NO: 42830 - DNA, 71 bp, chicken (Gallus Gallus)
  misc_feature (36): n=a or c
ggtctctttaattggcttgaaattacagagtagtanaacatgtactttgggaaagcttgcttaatatcacc

SEQ ID NO: 42831 - DNA, 71 bp, chicken (Gallus Gallus)
  misc_feature (36): n=c or t
ctgcagactggtgaagaggttgtccatccctggaanctttgctgcccttgttggtgtgcagcaggtcacaa

SEQ ID NO: 42832 - DNA, 71 bp, chicken (Gallus Gallus)
  misc_feature (36): n=a or g
tacttttctctttctgtttcacttaatcactttgtnctctccttcccactgaaattgaaacattggtaatg

SEQ ID NO: 42833 - DNA, 71 bp, chicken (Gallus Gallus)
  misc_feature (36): n=c or t
gtaatttatgaaaattagacttcatatttagtagcngtttccatatttccactcgttaggagtttattttt

SEQ ID NO: 42834 - DNA, 71 bp, chicken (Gallus Gallus)
  misc_feature (36): n=a or g
taataactgttgctacagagtttacaggcaaattcnaaaccattttaatctattctaattaaccttggtgc

SEQ ID NO: 42835 - DNA, 71 bp, chicken (Gallus Gallus)
  misc_feature (36): n=c or t
ttttcatttggaagatttgttatatttattagcttnttctggtaaatgctcaagtgagactgaacattttt

SEQ ID NO: 42836 - DNA, 71 bp, chicken (Gallus Gallus)
  misc_feature (36): n=c or t
tgtaagtgtttgatcaataaatcttacatttctttngttcattgattaagcaaaaggatttcagacaattc

SEQ ID NO: 42837 - DNA, 71 bp, chicken (Gallus Gallus)
  misc_feature (36): n=c or t
tagaagagtggtattgtgaagcttccagcagttttnattgagctgtcctcctccctatcccaatggcactg

SEQ ID NO: 42838 - DNA, 71 bp, chicken (Gallus Gallus)
  misc_feature (36): n=c or t
cgattttcagatgttcagtagtggcgttgctatcantgtactacattcttccacatgcagtgaagtttaga

SEQ ID NO: 42839 - DNA, 71 bp, chicken (Gallus Gallus)
  misc_feature (36): n=a or g
atatgcaaaatagtatttatcaatttcagatttctnctttagtagttttatagctaaatcccagggttaca

SEQ ID NO: 42840 - DNA, 71 bp, chicken (Gallus Gallus)
  misc_feature (36): n=c or t
agacttagtaggagcaggttcaaaggactactcttngactgaaagaacagagcaatgctatttgaaaacat

SEQ ID NO: 42841 - DNA, 71 bp, chicken (Gallus Gallus)
  misc_feature (36): n=a or g
taacaagaagaaactatcttctgttaaacttttagntaagaattttagagaatttgatgtgggaaaaacac

SEQ ID NO: 42842 - DNA, 71 bp, chicken (Gallus Gallus)
  misc_feature (36): n=a or g
ggaaaactaaaaagaaaaagtcgtggggtcttctgnttagattttaaaaatagttgttcaagccccagcac

SEQ ID NO: 42843 - DNA, 71 bp, chicken (Gallus Gallus)
  misc_feature (36): n=a or g
taaaactgtcagcgttatttatctctatgcctcacncagcctatcatattgtttgctttgctaatgccctt

SEQ ID NO: 42844 - DNA, 71 bp, chicken (Gallus Gallus)
  misc_feature (36): n=c or t
gattaaaaatacactagtatattgtttgatacacanacagcaacaatattcagatccttacctatagcttc

SEQ ID NO: 42845 - DNA, 71 bp, chicken (Gallus Gallus)
  misc_feature (36): n=a or g
tgaaactgagtttgttactttgccttaaaaagcagnccatatgcctaaaaagtgatctttctgatcggtat

SEQ ID NO: 42846 - DNA, 71 bp, chicken (Gallus Gallus)
  misc_feature (36): n=a or g
cccaacgattccagttcttatgattccttggtgagncagttgacaagcatcttgtcccatcttggtggtga

SEQ ID NO: 42847 - DNA, 71 bp, chicken (Gallus Gallus)
  misc_feature (36): n=a or g
ttgtaaattaaggaagaagctaaaaagagctttgangagaaggactcatgatgtgaaagcaaatctcacag

SEQ ID NO: 42848 - DNA, 71 bp, chicken (Gallus Gallus)
  misc_feature (36): n=a or g
agtgggaccagatcacaatggcaaatgagaacgacnatgcttcagccaatcattataaccttcccagcaag

SEQ ID NO: 42849 - DNA, 71 bp, chicken (Gallus Gallus)
  misc_feature (36): n=a or g
taataatgaaacaagaaacttgatgttaattcatcngggcgcatctctaaaattgatcattatctgtgttt

SEQ ID NO: 42850 - DNA, 71 bp, chicken (Gallus Gallus)
  misc_feature (36): n=g or t
ctcagtaagagttatgaaatatggagcttctttggnctggttgcctgactagcagtcactgcatggctgct

SEQ ID NO: 42851 - DNA, 71 bp, chicken (Gallus Gallus)
  misc_feature (36): n=a or g
tactacaccgacctgaggaaaaggagcattaggacnagacactgtacctcaaaaccttgttttaaaatgtc

SEQ ID NO: 42852 - DNA, 71 bp, chicken (Gallus Gallus)
  misc_feature (36): n=a or g
ctgagtagttccacttgtgtttgataaagtaacgcnagatgcttatgttaatccttgaatgccaaagtgca

SEQ ID NO: 42853 - DNA, 71 bp, chicken (Gallus Gallus)
  misc_feature (36): n=c or t
aagcattgctactcagagtgcctgagaaaagttcanctaactacgtctttcaagaattgtttactttgcat

SEQ ID NO: 42854 - DNA, 71 bp, chicken (Gallus Gallus)
  misc_feature (36): n=g or t
tcaaagctgtactgagcatcatgcaagaaaggaaangaagtcaaagaggacaaaggctttgttcacactcc

SEQ ID NO: 42855 - DNA, 71 bp, chicken (Gallus Gallus)
  misc_feature (36): n=c or t
tggacaatggtactctatctaaaacctggttctganagtaaatacacagcaaaaaaaatgaactttatttc

SEQ ID NO: 42856 - DNA, 71 bp, chicken (Gallus Gallus)
  misc_feature (36): n=c or t
gaagtcaagagaaataattaattgaatcacttgaanagaattctaatttgggaggtatatagctcttctcc

SEQ ID NO: 42857 - DNA, 71 bp, chicken (Gallus Gallus)
  misc_feature (36): n=c or t
ctaatgaactacagccttcaacatttctcataatgngtgtcctcagcagtcatcgagggtgtttgtcatga

SEQ ID NO: 42858 - DNA, 71 bp, chicken (Gallus Gallus)
  misc_feature (36): n=c or t
atacatcaactgcagttgtgctttagaagtacgtangcctctataggtatgaaacttagcaagaactgcag

SEQ ID NO: 42859 - DNA, 71 bp, chicken (Gallus Gallus)
  misc_feature (36): n=c or t
gtgcctgaattttcattctgcagtgacattcaaatnctaacacctttcaataatgtccaaaaaatgatggt

SEQ ID NO: 42860 - DNA, 71 bp, chicken (Gallus Gallus)
  misc_feature (36): n=a or c
gcaactcgggttcatatccatatattatattaaagnccttcagaggtgtgctcatcgataagcaagtattt

SEQ ID NO: 42861 - DNA, 71 bp, chicken (Gallus Gallus)
  misc_feature (36): n=c or t
ccagctgtgaactcccagtaaaatccacagtacaanactgagtactgggaaaagaacgtgtatagaataga

SEQ ID NO: 42862 - DNA, 71 bp, chicken (Gallus Gallus)
  misc_feature (36): n=c or t
cgcaggagggggctatttctaagagaaattttaacnaaattactactatcagatttcagaaacagattcca

SEQ ID NO: 42863 - DNA, 71 bp, chicken (Gallus Gallus)
  misc_feature (36): n=a or g
tgagctccacagaaaggcaaatgctgctatctaacntggtacagagggctggtgggggcagagcccctacc

SEQ ID NO: 42864 - DNA, 71 bp, chicken (Gallus Gallus)
  misc_feature (36): n=c or t
ataaggctcacagaagatttagggattttgtaatgntacacaagtaaaggcagctccgaataccccctgac

SEQ ID NO: 42865 - DNA, 71 bp, chicken (Gallus Gallus)
  misc_feature (36): n=c or t
gactaattgaaaccaaaaccatgcctggaaaggganaaaggatgtccaagttgatttaaaattggctaata

SEQ ID NO: 42866 - DNA, 71 bp, chicken (Gallus Gallus)
  misc_feature (36): n=g or t
aaacccctcttaccaaggctagtgttttgttggacnccatctctaggaaacccttgcaaaatggtgcatgg

SEQ ID NO: 42867 - DNA, 71 bp, chicken (Gallus Gallus)
  misc_feature (36): n=a or c
tacttctttcttgtattttcagctatcgccatcgtngaacagaacaggaagaagatgaggagctgttaaca

SEQ ID NO: 42868 - DNA, 71 bp, chicken (Gallus Gallus)
  misc_feature (36): n=a or g
aaagttttctgaccctagcccattagccctcccagnacagatcaataaacaattgaaacagctaagagttt

SEQ ID NO: 42869 - DNA, 71 bp, chicken (Gallus Gallus)
  misc_feature (36): n=c or t
acctgctcccatgtcccagaggaagaattaaaatgnttataatcataacacactggagaacaatcaaagtc

SEQ ID NO: 42870 - DNA, 71 bp, chicken (Gallus Gallus)
  misc_feature (36): n=a or g
cagtactagagcaccttcacattatctcctattgangtccacagggtttttaatgactcaacatattgtca

SEQ ID NO: 42871 - DNA, 71 bp, chicken (Gallus Gallus)
  misc_feature (36): n=a or g
tcaggagaaggcattgcttttgcaaacagagcaaanggggcaaaatatgagtagcctgttatcttttataa

SEQ ID NO: 42872 - DNA, 71 bp, chicken (Gallus Gallus)
  misc_feature (36): n=a or g
gtgtgtatgctggagtcgcatcttaagaactttcantggattccaaaatgcaagagtggggtcaaagcctg

SEQ ID NO: 42873 - DNA, 71 bp, chicken (Gallus Gallus)
  misc_feature (36): n=c or t
tgcacaagtgggctgactatgctcacagcactgcangagcacaagtaaaaggcactgtgtattttatttct

SEQ ID NO: 42874 - DNA, 71 bp, chicken (Gallus Gallus)
  misc_feature (36): n=c or t
taatttcataattcataatccttccattttataagngtttatagtagtatatcctagaacgtattctgtct

SEQ ID NO: 42875 - DNA, 71 bp, chicken (Gallus Gallus)
  misc_feature (36): n=a or g
caaaacttacatttttatcttgcaaatctctggccntctctactttggcatctttctatctggcttacagc

SEQ ID NO: 42876 - DNA, 71 bp, chicken (Gallus Gallus)
  misc_feature (36): n=g or t
taatgaaaaaagaggtgtctgacctggtgcagatgnccttccatgaagagcagtttcattaggcaggagat

SEQ ID NO: 42877 - DNA, 71 bp, chicken (Gallus Gallus)
  misc_feature (36): n=c or t
ccaaacaatgttctgcgtttctacagcttttgttgngtgtgactgatgtaagcttcaacaggcctacacag

SEQ ID NO: 42878 - DNA, 71 bp, chicken (Gallus Gallus)
  misc_feature (36): n=a or g
aaaataaaaactgcattctgtctacatgttcttacnttccccatcctgctgctctacctgtgggttttcct

SEQ ID NO: 42879 - DNA, 71 bp, chicken (Gallus Gallus)
  misc_feature (36): n=c or t
ctgtaaaagaggagctactctaagttttgtctgacnagagaagaatatttgttagatattacaaccatcta

SEQ ID NO: 42880 - DNA, 71 bp, chicken (Gallus Gallus)
  misc_feature (36): n=c or t
tgtaaggctgtatttcagcctcactgaaacaagtcntgaataagtcctgtctgggctgtgcaattctctgg

SEQ ID NO: 42881 - DNA, 71 bp, chicken (Gallus Gallus)
  misc_feature (36): n=c or t
gaggtctggatactagcagaccgagaacactgtgtngacaccgatctcacaatattaacaatgaacagtac

SEQ ID NO: 42882 - DNA, 71 bp, chicken (Gallus Gallus)
  misc_feature (36): n=c or t
actgagacaccgtggcttttgaaaagggatactgcnactgggaacacgtctgatgatttctaccaatgctt

SEQ ID NO: 42883 - DNA, 71 bp, chicken (Gallus Gallus)
  misc_feature (36): n=a or g
gaggacaatggggtgtcaaagcaagtggtgcaaacncaggaaactttagtggtgggaaatgtatgcatgca

SEQ ID NO: 42884 - DNA, 71 bp, chicken (Gallus Gallus)
  misc_feature (36): n=c or t
acaacaaaagcaactcattgcattaggaaaagtgancacaaagaggcaggaggaggcactgtagctcaatg

SEQ ID NO: 42885 - DNA, 71 bp, chicken (Gallus Gallus)
  misc_feature (36): n=a or g
gcagttgagaaccaaacaattcctactgaaggcaangctgcagagaggccagtgactaacatgtctagacc

SEQ ID NO: 42886 - DNA, 71 bp, chicken (Gallus Gallus)
  misc_feature (36): n=c or t
acttgctttccttgatactccttatatgaaagtaantgccatttaccgtcttacagtgatgttacattcaa

SEQ ID NO: 42887 - DNA, 71 bp, chicken (Gallus Gallus)
  misc_feature (36): n=c or t
gtaaaaatacacagctataagtggtcttgtcctttnaaaatgttactgtcagggcacacaatcacttacaa

SEQ ID NO: 42888 - DNA, 71 bp, chicken (Gallus Gallus)
  misc_feature (36): n=a or g
caaaaaggcaagttgcatcacatttacaacagagcncaagtgcacagtttacctgctctatgataactacc

SEQ ID NO: 42889 - DNA, 71 bp, chicken (Gallus Gallus)
  misc_feature (36): n=c or t
ccaagtcacttcaaagtagtcaggttttcattcttnacgtgcttcaggtattttattcagaggaggagtat

SEQ ID NO: 42890 - DNA, 71 bp, chicken (Gallus Gallus)
  misc_feature (36): n=a or c
agcagatctagaggtctagtggactgcagttggtgnatcagtagcctaaggcttgcaaagagctctaaagc

SEQ ID NO: 42891 - DNA, 71 bp, chicken (Gallus Gallus)
  misc_feature (36): n=c or t
gggaaagatggtgagttctaagcttttgagcataangtctttcttttagtctgttgttcttattccatagg

SEQ ID NO: 42892 - DNA, 71 bp, chicken (Gallus Gallus)
  misc_feature (36): n=a or g
tgacttgggggactgcaggttctgctatgaagagtncagtgctacagccctgctgctgctcagagggccag

SEQ ID NO: 42893 - DNA, 71 bp, chicken (Gallus Gallus)
  misc_feature (36): n=a or g
cacaaagaaagaccacagctggagagaaagaaaatnatcatcccaccttttaccttttaaaactactactg

SEQ ID NO: 42894 - DNA, 71 bp, chicken (Gallus Gallus)
  misc_feature (36): n=a or g
cagacaacaggaaatgcgttgtaggcagcaaaactnagtctccctgttgacactgagaccaaaactcaact

SEQ ID NO: 42895 - DNA, 71 bp, chicken (Gallus Gallus)
  misc_feature (36): n=c or t
gaccatgcttaaaacaatgcttccagaaacaatacncaatttgggggcagtagtttgaggccctcctcgag

SEQ ID NO: 42896 - DNA, 71 bp, chicken (Gallus Gallus)
  misc_feature (36): n=a or g
tgacatttagcccagctggtagaatgatataccacnagtatctggtgcattttcatctgaatttcctttcc

SEQ ID NO: 42897 - DNA, 71 bp, chicken (Gallus Gallus)
  misc_feature (36): n=a or g
ggacttttcacatggcaataatgtggtaagactgantatggcaaaagcagctgtatttccagttgggtggt

SEQ ID NO: 42898 - DNA, 71 bp, chicken (Gallus Gallus)
  misc_feature (36): n=c or t
ccttttccccttcttttggcaaatgcttcacaccgnatggcttatggctacctttatcagctctgtgcaaa

SEQ ID NO: 42899 - DNA, 71 bp, chicken (Gallus Gallus)
  misc_feature (36): n=c or t
aaaactgttgccaggaaaagacgacaagcttagtgnagctaaagccatcacatcttctatttatgtagtcc

SEQ ID NO: 42900 - DNA, 71 bp, chicken (Gallus Gallus)
  misc_feature (36): n=a or g
cttaaaggcaagtagaagatactaaaggtgttcctntcaacccttccagtatcctttgtcctgacttcaca

SEQ ID NO: 42901 - DNA, 71 bp, chicken (Gallus Gallus)
  misc_feature (36): n=a or g
catcagcaatagctcaaagtactcctcagtgatggnaatagaatgaaacagtagtcaagcaatctgttata

SEQ ID NO: 42902 - DNA, 71 bp, chicken (Gallus Gallus)
  misc_feature (36): n=c or t
tgccttaagctagtgctgaacctcttttgttctggnctcggtttcagtagtgaaggacactgatggtttag

SEQ ID NO: 42903 - DNA, 71 bp, chicken (Gallus Gallus)
  misc_feature (36): n=g or t
ttatattatctgtgtttcaaagctgaatcacaagtncgtgtgctaaaagcttgaatttttttgtactagaa

SEQ ID NO: 42904 - DNA, 71 bp, chicken (Gallus Gallus)
  misc_feature (36): n=a or g
ctaacaaacctgctggtgctttccatttctgacaanaacagaactaagcagaaacagttctttttatttct

SEQ ID NO: 42905 - DNA, 71 bp, chicken (Gallus Gallus)
  misc_feature (36): n=a or c
tttcgtttggtttgggttgtgcagtaggttcctcancggcagatactcaggccttcgttcaagcaatgcag

SEQ ID NO: 42906 - DNA, 71 bp, chicken (Gallus Gallus)
  misc_feature (36): n=c or t
aaagttaaacaaacttctgtgtcaaactgttctcantgagttcctcatgtatttaacgtaaggacttccag

SEQ ID NO: 42907 - DNA, 71 bp, chicken (Gallus Gallus)
  misc_feature (36): n=c or t
gagcagcttttgaaatagtgctagatgaattccacnggtaaagctctttctgctacaccacagactgagca

SEQ ID NO: 42908 - DNA, 71 bp, chicken (Gallus Gallus)
  misc_feature (36): n=a or g
ctttagctgctgcaggcagctaaaaagtttcaggcntgtattatgctttgcagctattcaatatacacagt

SEQ ID NO: 42909 - DNA, 71 bp, chicken (Gallus Gallus)
  misc_feature (36): n=c or t
cactggactgttcagaaggcactacaaaatctcccngtttctctgctgcactttttcattttccagatgcc

SEQ ID NO: 42910 - DNA, 71 bp, chicken (Gallus Gallus)
  misc_feature (36): n=c or t
caaactaatagttaacctccaaactacctaaaacangtttagtacatatgtgagtggctataaactgcatt

SEQ ID NO: 42911 - DNA, 71 bp, chicken (Gallus Gallus)
  misc_feature (36): n=a or g
tcctttccaacccgagtaattctatgattacagcancataaaaaggataaaaatctaaacaggcaaaggat

SEQ ID NO: 42912 - DNA, 71 bp, chicken (Gallus Gallus)
  misc_feature (36): n=a or c
acaaattacagtcactacatctcacatttcatccantctgaatcttcaaatgacacaacttcaggccatgc

SEQ ID NO: 42913 - DNA, 71 bp, chicken (Gallus Gallus)
  misc_feature (36): n=c or t
ttctagaagtcatatcagccaatatcaatgctgaanttgaccccaaatatccattccactgctttaacata

SEQ ID NO: 42914 - DNA, 71 bp, chicken (Gallus Gallus)
  misc_feature (36): n=g or t
ccagcagtgattcgttgcttctcctttcgctgcctnaaaagcaggaccagccccagtgcaaacagcagatt

SEQ ID NO: 42915 - DNA, 71 bp, chicken (Gallus Gallus)
  misc_feature (36): n=c or t
cagtaggataattctgtaattaaataattgtatcanaatcactaatttgtgagtcgaacgccaagaagttt

SEQ ID NO: 42916 - DNA, 71 bp, chicken (Gallus Gallus)
  misc_feature (36): n=c or t
taaaagcatacatattctcatatctttagatgttanatgtaccattggatttgtaactattgcataaatat

SEQ ID NO: 42917 - DNA, 71 bp, chicken (Gallus Gallus)
  misc_feature (36): n=a or g
gtgctttatgaaaggagcagcttaaaaacgcccaanctttgacagcttattagcattctgattgtgctggc

SEQ ID NO: 42918 - DNA, 71 bp, chicken (Gallus Gallus)
  misc_feature (36): n=g or t
gcttcttctctaatatttgcttcaccagaagagggntggctcggcctcgcgtagctttccgaaccagtcca

SEQ ID NO: 42919 - DNA, 71 bp, chicken (Gallus Gallus)
  misc_feature (36): n=c or t
aagtaaatcctattgtaccaagcccaagactaaatnctgatctgttgtttctgaaggtagcctgacatagt

SEQ ID NO: 42920 - DNA, 71 bp, chicken (Gallus Gallus)
  misc_feature (36): n=a or g
tgcgtgcatgtatgtgtttgcaggagagtgtgaacntgagtacatgaatacatatcaatgtgcaaatactg

SEQ ID NO: 42921 - DNA, 71 bp, chicken (Gallus Gallus)
  misc_feature (36): n=a or g
tccctaatttcctctgtacacttaagggataattanttccttataaacatacttcatcctgaaatcttttg

SEQ ID NO: 42922 - DNA, 71 bp, chicken (Gallus Gallus)
  misc_feature (36): n=c or t
agctgcaaagaaccaggatactggagatgatgcttngctctgggttgctaaaataaactcttgttttggtg

SEQ ID NO: 42923 - DNA, 71 bp, chicken (Gallus Gallus)
  misc_feature (36): n=a or c
tgcttaagaaccagaattggttttctgtaccataancacagatgaaatagtagattgagggtaatttgcat

SEQ ID NO: 42924 - DNA, 71 bp, chicken (Gallus Gallus)
  misc_feature (36): n=a or c
acacctttaagccttcagtgtgcaaactgttcactnagtaaatccaacacttctgtaaagctcttgctctt

SEQ ID NO: 42925 - DNA, 71 bp, chicken (Gallus Gallus)
  misc_feature (36): n=a or g
agctgttccagcatcacctgtgcgttccccttcccntgtggcgctcacccttgtgtttctgcaggcgcaaa

SEQ ID NO: 42926 - DNA, 71 bp, chicken (Gallus Gallus)
  misc_feature (36): n=a or c
acagtaagagaataacagaaggtatttcttttctgnatattaaagcatgtaagcaagacaaagtataataa

SEQ ID NO: 42927 - DNA, 71 bp, chicken (Gallus Gallus)
  misc_feature (36): n=c or t
atcttgttccttcatgctccgattgttggggagtangactgagctctggctcctcagtcagcgcagacatc

SEQ ID NO: 42928 - DNA, 71 bp, chicken (Gallus Gallus)
  misc_feature (36): n=a or g
aggataacaacctgtcagtgggacatcccaaacacnctttacatattactggaacagaattttacttctaa

SEQ ID NO: 42929 - DNA, 71 bp, chicken (Gallus Gallus)
  misc_feature (36): n=a or g
acaaattattttcagaaagacaagaatccgaaagtntaggtttggttatcacaattaactagctatgatct

SEQ ID NO: 42930 - DNA, 71 bp, chicken (Gallus Gallus)
  misc_feature (36): n=a or g
cccacacacccggaacacacctctttaagagtgcantgacgaggagctcaggacggggagatatcttggtc

SEQ ID NO: 42931 - DNA, 71 bp, chicken (Gallus Gallus)
  misc_feature (36): n=a or g
tataaaagtgctaaaactacttctactcaccttcanattgcccttcaccagggccaaacagcagtcacttg

SEQ ID NO: 42932 - DNA, 71 bp, chicken (Gallus Gallus)
  misc_feature (36): n=c or t
ctctctccagttggacttcagtattcatcagtttcncactcttctgtcagttctttattcatctgtttcct

SEQ ID NO: 42933 - DNA, 71 bp, chicken (Gallus Gallus)
  misc_feature (36): n=c or t
gttgtaatggacatatgacatacggtgtctgaatgntattcttaacgaatctctgcccttgcctgcaggtg

SEQ ID NO: 42934 - DNA, 71 bp, chicken (Gallus Gallus)
  misc_feature (36): n=a or g
caagccgttgtcttttgactgcagtttgctcattcntgcatcgctgatactgtggttgacttaagtcatta

SEQ ID NO: 42935 - DNA, 71 bp, chicken (Gallus Gallus)
  misc_feature (36): n=c or t
caatatttctattgcgaatgccctcaagcatttaantgatgtaacacctctaattgcccaatgaacatatt

SEQ ID NO: 42936 - DNA, 71 bp, chicken (Gallus Gallus)
  misc_feature (36): n=a or g
gatgaatagcaggaagaatgggagctgttgctcacnagatgtaagggatgttaaatgaagtcatagaccag

SEQ ID NO: 42937 - DNA, 71 bp, chicken (Gallus Gallus)
  misc_feature (36): n=c or t
cagcacaggggtcaaacagaaagaattgtgtcagtntcctataggagacagcccggccaaagaagcagaac

SEQ ID NO: 42938 - DNA, 71 bp, chicken (Gallus Gallus)
  misc_feature (36): n=a or g
agtatttacccttttcttcctgagatagctccatcntttccgacttgcacctgagtgcagcccacgccgtg

SEQ ID NO: 42939 - DNA, 71 bp, chicken (Gallus Gallus)
  misc_feature (36): n=g or t
gatggcagttagagctcagcactgctggagctaggnaactgcttattccaaacgtgctgagattactcctg

SEQ ID NO: 42940 - DNA, 71 bp, chicken (Gallus Gallus)
  misc_feature (36): n=c or t
accttaaatgttccggtaaatgaaatcactggtgantttccctactttggttgctgatccacacgctcctg

SEQ ID NO: 42941 - DNA, 71 bp, chicken (Gallus Gallus)
  misc_feature (36): n=c or t
tctcttagataaagtcccagttccagttaactcatntcaaagttcttcagtgctcactgaatgtgacaaag

SEQ ID NO: 42942 - DNA, 71 bp, chicken (Gallus Gallus)
  misc_feature (36): n=c or t
gtaacacacacccatccactctcttgcaaaattcangctccgtaattgaggggattaaaatgtctatgcat

SEQ ID NO: 42943 - DNA, 71 bp, chicken (Gallus Gallus)
  misc_feature (36): n=c or t
aagcagcagtgtgagataaatatgtacgtgtcaaanttgtgaaactatcagtgtcatgaacctgcttgcac

SEQ ID NO: 42944 - DNA, 71 bp, chicken (Gallus Gallus)
  misc_feature (36): n=a or g
aggctgtccagtaggaactgaaaaactgctggtctntttgaagtaatgtaattattatggatgtatgcctt

SEQ ID NO: 42945 - DNA, 71 bp, chicken (Gallus Gallus)
  misc_feature (36): n=g or t
tagatgtatacagatctctttgcaaaaagcttggtntggtggagtgtctatggcagaagtttcctccctgt

SEQ ID NO: 42946 - DNA, 71 bp, chicken (Gallus Gallus)
  misc_feature (36): n=c or t
gctttgttgttggaaggaaaggctctgaaatgtgcntaatcagtgtcagatagagctttctgtaatttgtc

SEQ ID NO: 42947 - DNA, 71 bp, chicken (Gallus Gallus)
  misc_feature (36): n=g or t
ggtctagattgtattgcatgagtgttaattaaactnctgttgactttaatgtgtgagaatttaatcacaaa

SEQ ID NO: 42948 - DNA, 71 bp, chicken (Gallus Gallus)
  misc_feature (36): n=a or g
tgcagatataattaagctcacagcactaaagtcccnaggaatttattctacataaacgatggaagaaatgt

SEQ ID NO: 42949 - DNA, 71 bp, chicken (Gallus Gallus)
  misc_feature (36): n=a or g
tagtaccgtatatttaaggattgcaaaccttttacntgtttatattattggttaaatatctatccttgctc

SEQ ID NO: 42950 - DNA, 71 bp, chicken (Gallus Gallus)
  misc_feature (36): n=g or t
gccttctttaaaattctgttatgaacagatcttttntttcccatcctgaagacaggacccaactggcacta

SEQ ID NO: 42951 - DNA, 71 bp, chicken (Gallus Gallus)
  misc_feature (36): n=a or c
ttcttatgcaactatttagagtccttacaaatgtgncccaggaagatgaagtagccgtcaactgcaccatg

SEQ ID NO: 42952 - DNA, 71 bp, chicken (Gallus Gallus)
  misc_feature (36): n=c or t
tacaagtttgaatttctccaaaccatttgcaatcangagcactacattcctctgaacttaccgatgacctt

SEQ ID NO: 42953 - DNA, 71 bp, chicken (Gallus Gallus)
  misc_feature (36): n=c or t
aggaaattatttggggaaagaagaggtaaattttanatattcaggaataaagaatagattccatttccaaa

SEQ ID NO: 42954 - DNA, 71 bp, chicken (Gallus Gallus)
  misc_feature (36): n=a or g
gagcccatcgctgcacgcaagtaagcatccaggctnggcactgctgggtatgtgcctgctcgtccccatcc

SEQ ID NO: 42955 - DNA, 71 bp, chicken (Gallus Gallus)
  misc_feature (36): n=c or t
ggtataaaagggaagttaacaaaacattccagaccngcaggaattaaaatagactgtgttggccataacat

SEQ ID NO: 42956 - DNA, 71 bp, chicken (Gallus Gallus)
  misc_feature (36): n=a or c
ggccatgagagatcaccaaattaaatgtagtccagntgggtatgaaaaatatccagctcatttcataatca

SEQ ID NO: 42957 - DNA, 71 bp, chicken (Gallus Gallus)
  misc_feature (36): n=a or g
cacagaagtgacctccgtgtagccatcccttcacanaacagtgtattgtcattctattctctgtgccacca

SEQ ID NO: 42958 - DNA, 71 bp, chicken (Gallus Gallus)
  misc_feature (36): n=a or c
ctgacccacagctctccacacagcgcccattctgcngctgcttcttcacatcacggcaggcaatacagtga

SEQ ID NO: 42959 - DNA, 71 bp, chicken (Gallus Gallus)
  misc_feature (36): n=a or g
gtgttccatactcttggctgggagcacaacttccanacctgccaggggcaaaacactcttcacactgtaaa

SEQ ID NO: 42960 - DNA, 71 bp, chicken (Gallus Gallus)
  misc_feature (36): n=c or t
gagcaacttctctccttcttctcaccagttgcacancaggacagatctcacagactggtcgatctggcagt

SEQ ID NO: 42961 - DNA, 71 bp, chicken (Gallus Gallus)
  misc_feature (36): n=c or t
aggtctctgcagctgctgtcttccttgttcggagtnagtgtgcacaaatggggaggtgctttttccttttg

SEQ ID NO: 42962 - DNA, 71 bp, chicken (Gallus Gallus)
  misc_feature (36): n=g or t
tgtttgccacagcatggctgacatttgtctctgctnctttctgcctgttcaaagcagtatttaccaacctt

SEQ ID NO: 42963 - DNA, 71 bp, chicken (Gallus Gallus)
  misc_feature (36): n=a or g
tatactaacaacatacagcaaaactaacagatgacngtgtaagagggtcctacttggagatgttttactgc

SEQ ID NO: 42964 - DNA, 71 bp, chicken (Gallus Gallus)
  misc_feature (36): n=a or g
tgcaaggctgctggaagctctctgccaaaagtgacncttagcaacagcaggcagcatgtaaaggcaggagg

SEQ ID NO: 42965 - DNA, 71 bp, chicken (Gallus Gallus)
  misc_feature (36): n=g or t
tttccgacctgctgtccggataaattcagtatcacnttgagcgagctcctttttctcagcaggatgaccta

SEQ ID NO: 42966 - DNA, 71 bp, chicken (Gallus Gallus)
  misc_feature (36): n=g or t
tgcatattaacaaggaagctccctcacttcaaagcntttgcctttttcccctttaatatgactctgcctta

SEQ ID NO: 42967 - DNA, 71 bp, chicken (Gallus Gallus)
  misc_feature (36): n=c or t
gtcttatgaaaaatgatttcatggtatttatatcanctctcttgttaaacttgcatcatattttgcctcat

SEQ ID NO: 42968 - DNA, 71 bp, chicken (Gallus Gallus)
  misc_feature (36): n=c or t
actgtactcatggaagaccgttaaattctttaaatnctgagaatcacattcatttctcagtgttcacaaat

SEQ ID NO: 42969 - DNA, 71 bp, chicken (Gallus Gallus)
  misc_feature (36): n=a or g
tctcagtcttccagcagttacttttatacccaaccntgcttaagttaaggtcacgctgaagtacctgctta

SEQ ID NO: 42970 - DNA, 71 bp, chicken (Gallus Gallus)
  misc_feature (36): n=c or t
tgggtcacttcccaaaaatcctagaggcacaaaagnttgaaaacagagataaatagcttctatacattatc

SEQ ID NO: 42971 - DNA, 71 bp, chicken (Gallus Gallus)
  misc_feature (36): n=c or t
ggcatttcaggctcaaataaggccatgacagtacangttaactgaagctctaacatttaaattagatttaa

SEQ ID NO: 42972 - DNA, 71 bp, chicken (Gallus Gallus)
  misc_feature (36): n=c or t
gtgctaaaggggtcaaactcaaggctcgcctaatcnactactctccttatcacagacaagaataatcaaca

SEQ ID NO: 42973 - DNA, 71 bp, chicken (Gallus Gallus)
  misc_feature (36): n=a or g
ttcctgaacattctgtatcttgaatttgaacaatgngggagatggagatctcaacacatctctatcattcc

SEQ ID NO: 42974 - DNA, 71 bp, chicken (Gallus Gallus)
  misc_feature (36): n=c or t
gtctctgaacatctgccagcattttagatggtaaancactcatttgaatcagctgagggcatgatgtgaag

SEQ ID NO: 42975 - DNA, 71 bp, chicken (Gallus Gallus)
  misc_feature (36): n=c or t
aaataacacgcttgtgtgctcaggaagaagaattcngtgacttgatttatggtatttaatgccaatccaga

SEQ ID NO: 42976 - DNA, 71 bp, chicken (Gallus Gallus)
  misc_feature (36): n=a or g
acctccacaccactggagcacagggccatgcccacngcctcctcagctgtgacccaaagcatggcagaagt

SEQ ID NO: 42977 - DNA, 71 bp, chicken (Gallus Gallus)
  misc_feature (36): n=c or t
cttagtttaaagcccaattctgtaaacaaacaaaancaaaccattgagatgataaactgagccattttcat

SEQ ID NO: 42978 - DNA, 71 bp, chicken (Gallus Gallus)
  misc_feature (36): n=a or g
tttttctggtagacaattatttatatggtctaatanagcctcatctcaaagcctcttgaaggtgctgggaa

SEQ ID NO: 42979 - DNA, 71 bp, chicken (Gallus Gallus)
  misc_feature (36): n=c or t
tcagttcagtttggatggtgctattcacaagtcatngggttttctccatgttgatccacatttctgcagag

SEQ ID NO: 42980 - DNA, 71 bp, chicken (Gallus Gallus)
  misc_feature (36): n=a or g
ttatctgtaagagtctgctttctttcatgtgaacantgaggaaaaatgagttcatgcctttagcagaaatg

SEQ ID NO: 42981 - DNA, 71 bp, chicken (Gallus Gallus)
  misc_feature (36): n=c or t
tcgcctgaagtacctctcttttatgtcttctaaatntctctgctttcttggtctttctaaatactgcacat

SEQ ID NO: 42982 - DNA, 71 bp, chicken (Gallus Gallus)
  misc_feature (36): n=a or c
gatatagaaagagttatcaatcaaaagaaacaaaanacaatgtttgcacagatcctgagatggtgaatcta

SEQ ID NO: 42983 - DNA, 71 bp, chicken (Gallus Gallus)
  misc_feature (36): n=a or g
cattatttttagccctacttaatctggaaatgttcntgagttaagttattgaaatttctgcttgattttcc

SEQ ID NO: 42984 - DNA, 71 bp, chicken (Gallus Gallus)
  misc_feature (36): n=a or g
ttgatacattgggctttgtttatttcatgcatcacnttgccagaagacagaattcgttgatcaataggttc

SEQ ID NO: 42985 - DNA, 71 bp, chicken (Gallus Gallus)
  misc_feature (36): n=a or c
ggactaatagatccctgcatcttatgtcaacaaaanaaattcctgtttaaaggaattcagttttaataaaa

SEQ ID NO: 42986 - DNA, 71 bp, chicken (Gallus Gallus)
  misc_feature (36): n=c or t
cagtattacttctggattattcttaatgcgacattnatcttggactctaaacagactgtttttcttcctcc

SEQ ID NO: 42987 - DNA, 71 bp, chicken (Gallus Gallus)
  misc_feature (36): n=c or t
aattgctttactttcagcactccatgtcaggaaaantaaagccagatccattacatcaaggtctgttccag

SEQ ID NO: 42988 - DNA, 71 bp, chicken (Gallus Gallus)
  misc_feature (36): n=a or c
tttaagacagactttaacacagaagtgataataggnaagatacttaattttttgaatagtgatgacttcaa

SEQ ID NO: 42989 - DNA, 71 bp, chicken (Gallus Gallus)
  misc_feature (36): n=a or g
cttgcagtttgttgagtgaagcttattccctgccanttattttttactgtatgctttatgatattctacta

SEQ ID NO: 42990 - DNA, 71 bp, chicken (Gallus Gallus)
  misc_feature (36): n=a or g
gtcggagtacaagcgacatcatgcacaggccctgcnataaatgggtatgcagacaggctgctttgtcagtg

SEQ ID NO: 42991 - DNA, 71 bp, chicken (Gallus Gallus)
  misc_feature (36): n=a or g
gttttgttgtttttgtgattccccctttaaaaaggnctgagtcccaatgcaacactctgtgaaggtaggta

SEQ ID NO: 42992 - DNA, 71 bp, chicken (Gallus Gallus)
  misc_feature (36): n=a or c
ggtagcatcctatgtgacatacttttgtttcaatgnaatacacttactagagatgggacatcagtgggaca

SEQ ID NO: 42993 - DNA, 71 bp, chicken (Gallus Gallus)
  misc_feature (36): n=a or g
gaactcagaaggcagaactctttgcagaaggagtcntaaaaagaatgattctcgtagttgatgcccacctg

SEQ ID NO: 42994 - DNA, 71 bp, chicken (Gallus Gallus)
  misc_feature (36): n=c or t
taatgaaagattttggtggactacattataggcttntcaacctagaagtccattgataacctcaggcaaaa

SEQ ID NO: 42995 - DNA, 71 bp, chicken (Gallus Gallus)
  misc_feature (36): n=a or g
taaacaggttcctctagtaatgcataaggcaacaantatcctacttcagatgtcttacagtcatgtaaaat

SEQ ID NO: 42996 - DNA, 71 bp, chicken (Gallus Gallus)
  misc_feature (36): n=a or g
catttgtacccatatgctgatttcaactaatgtgtntgtctgttctcaactgtgatcacaccagcctgcca

SEQ ID NO: 42997 - DNA, 71 bp, chicken (Gallus Gallus)
  misc_feature (36): n=c or t
tctgagttactaatgaaagttcaaagtacaatctgnaaatccctgtcagtccctttagcagtctcagatgt

SEQ ID NO: 42998 - DNA, 71 bp, chicken (Gallus Gallus)
  misc_feature (36): n=a or g
ggagaaataacttcaccagctgtagtactgtaggtngagctcctaaacatgctcaaaaagatcatcaatct

SEQ ID NO: 42999 - DNA, 71 bp, chicken (Gallus Gallus)
  misc_feature (36): n=c or t
tttcgataatttgacagaatagcctcaaatgtgcantgctgatgtgctcgggctctgatagtgatttccca

SEQ ID NO: 43000 - DNA, 71 bp, chicken (Gallus Gallus)
  misc_feature (36): n=c or t
cctaatttcacgtcacaagtaacactaagcatgcanaggtataaagagtgaggtccatagatacaagaagg

SEQ ID NO: 43001 - DNA, 71 bp, chicken (Gallus Gallus)
  misc_feature (36): n=c or t
tttctccatagagcccatctgacgatggggaccggngtggcactacaaagtccctgtaacgtgaggcagag

SEQ ID NO: 43002 - DNA, 71 bp, chicken (Gallus Gallus)
  misc_feature (36): n=c or t
tcttttagatcatttattgggatttttacactagtngagaaaagcataatctgcatgtatctcaaacaagt

SEQ ID NO: 43003 - DNA, 71 bp, chicken (Gallus Gallus)
  misc_feature (36): n=c or t
acttttcagcaaaaagcagtcagagttgtgctatantgatttccagggtggaaagggatgaaaaaataaag

SEQ ID NO: 43004 - DNA, 71 bp, chicken (Gallus Gallus)
  misc_feature (36): n=a or g
tgttttgctctctgtccgctcagcccatctctcatncggagctctgatatttccaaacaggctcttgattc

SEQ ID NO: 43005 - DNA, 71 bp, chicken (Gallus Gallus)
  misc_feature (36): n=a or g
atggatctctcttcccagctctcagtctataaaatnaagaaggtgtggggttttttctaaaaacaaacaaa

SEQ ID NO: 43006 - DNA, 71 bp, chicken (Gallus Gallus)
  misc_feature (36): n=c or t
atttgacctgttttctatctgtaaggcaacaccgtnctcattcctattttttaggtattatttggtttatc

SEQ ID NO: 43007 - DNA, 71 bp, chicken (Gallus Gallus)
  misc_feature (36): n=a or g
ggtgggactcagttacaaatggcccttgtttaagtnctaccactgtaatactcgctgattatttctgctta

SEQ ID NO: 43008 - DNA, 71 bp, chicken (Gallus Gallus)
  misc_feature (36): n=c or t
tggaaaaaaatattcaagattccaagattcatttcnatctgtgaaagacatggtcagttcgagcaaaataa

SEQ ID NO: 43009 - DNA, 71 bp, chicken (Gallus Gallus)
  misc_feature (36): n=a or g
gatttctgttatctctgacaccacatataaaacaantacatagaattttgcagcagactggccaaaatgca

SEQ ID NO: 43010 - DNA, 71 bp, chicken (Gallus Gallus)
  misc_feature (36): n=c or t
gcagtcatcctctgcacttccataatggttgcctcngtgaagggcatttgagccttgtgggcaagagaggg

SEQ ID NO: 43011 - DNA, 71 bp, chicken (Gallus Gallus)
  misc_feature (36): n=a or g
tgagaaactaactggcatagtgagggaagggaaganggggaaagggtatgtcaggcttcttgtctgacatt

SEQ ID NO: 43012 - DNA, 71 bp, chicken (Gallus Gallus)
  misc_feature (36): n=c or t
tcagtgtccaagaggcattttgtccaaacataaaantgtgattattccttttatatacaggacatcgtacc

SEQ ID NO: 43013 - DNA, 71 bp, chicken (Gallus Gallus)
  misc_feature (36): n=a or g
gaaaacctattgatgctagtgagcctttcttccagnaaagggaaggggaggaccaatcttttgataaagga

SEQ ID NO: 43014 - DNA, 71 bp, chicken (Gallus Gallus)
  misc_feature (36): n=c or t
tgttcttagtaactgtaaatctgaaggaggaagtgnttttaggagatggaatagacatgcatcaccctctt

SEQ ID NO: 43015 - DNA, 71 bp, chicken (Gallus Gallus)
  misc_feature (36): n=c or t
atcagccactgtgaaccaaatggagtcaactgtaancaatactcaggtgaagagtcatgaaagaaaactca

SEQ ID NO: 43016 - DNA, 71 bp, chicken (Gallus Gallus)
  misc_feature (36): n=a or g
tttaaaagctatgtttatcaggcaaatgtttaaaancacctaaaggcattttactgctatgtagaggatat

SEQ ID NO: 43017 - DNA, 71 bp, chicken (Gallus Gallus)
  misc_feature (36): n=a or c
ctgcacactggtagcatctaaactgctcaagggttngtttgtgaacattcaagatggagtaaagggtgaac

SEQ ID NO: 43018 - DNA, 71 bp, chicken (Gallus Gallus)
  misc_feature (36): n=a or g
tagaaaactaaggtatttcaataggcttagtagtancaaacccaggatattaatgttagattattcccccc

SEQ ID NO: 43019 - DNA, 71 bp, chicken (Gallus Gallus)
  misc_feature (36): n=a or g
gcaacacaaaagcccagtggtattttgcaactgcangagcacaagcgtttgtttgtttgccaccacactct

SEQ ID NO: 43020 - DNA, 71 bp, chicken (Gallus Gallus)
  misc_feature (36): n=c or t
tggtgagatcttcatctttgtatgttttgaaggtcnagctggacagtgtcctgggaaagcttgtctgaatt

SEQ ID NO: 43021 - DNA, 71 bp, chicken (Gallus Gallus)
  misc_feature (36): n=c or t
taagtcttcatattcctccatatacagcaaccagancacagaggagaaaaaacacaaagcagaactagaaa

SEQ ID NO: 43022 - DNA, 71 bp, chicken (Gallus Gallus)
  misc_feature (36): n=a or g
ttgtaaatttcactggaataaccattgttctgtacnatgtattactgaggtctgttcatgggtctgcaggt

SEQ ID NO: 43023 - DNA, 71 bp, chicken (Gallus Gallus)
  misc_feature (36): n=a or g
ctggaagtgaaagtagaggcacggaatacagcaacnagtacaacaacatcaatgcatgaaggggagtgaga

SEQ ID NO: 43024 - DNA, 71 bp, chicken (Gallus Gallus)
  misc_feature (36): n=c or t
ggagtaaaagagtggtactgtaggcctccttcctanatctgaaaggagcagagccagagtatgcagcttca

SEQ ID NO: 43025 - DNA, 71 bp, chicken (Gallus Gallus)
  misc_feature (36): n=a or g
gcacgcacccagaaactgaggagcactgggggaacntcaatatcaggatgatacccgaggtgatgaagtgg

SEQ ID NO: 43026 - DNA, 71 bp, chicken (Gallus Gallus)
  misc_feature (36): n=g or t
acattgctcacaattcttacaaagaacagaacatgnttcgcttttggctacacagagaagttttatttcag

SEQ ID NO: 43027 - DNA, 71 bp, chicken (Gallus Gallus)
  misc_feature (36): n=a or g
taactgctctcattaatttttacttgttatcacacngtagcacaaccactaagagatgacatgggaagaaa

SEQ ID NO: 43028 - DNA, 71 bp, chicken (Gallus Gallus)
  misc_feature (36): n=a or g
ttgattatatgtgaggttaaaagattaattaaaagnaaaatgggttggtacaagtggtagctttctacacc

SEQ ID NO: 43029 - DNA, 71 bp, chicken (Gallus Gallus)
  misc_feature (36): n=a or c
ggtgatgccatttgcttggatactggcatccaaaantaaagccaatacgcctgtaatcacaagtgctgcaa

SEQ ID NO: 43030 - DNA, 71 bp, chicken (Gallus Gallus)
  misc_feature (36): n=c or t
cacatacagttaccaccactatatgcaggatcgcantgatgacagcggctggggctgcgcttatcggtctt

SEQ ID NO: 43031 - DNA, 71 bp, chicken (Gallus Gallus)
  misc_feature (36): n=a or g
catcttcttgacccatcagcttagatggagacaatntggcaggggatggaaatacaccatggagattttag

SEQ ID NO: 43032 - DNA, 71 bp, chicken (Gallus Gallus)
  misc_feature (36): n=a or g
ccttgcttaaagaggagctgcactggagagatgtantctctgaattcaccttccctggctggcagccgtga

SEQ ID NO: 43033 - DNA, 71 bp, chicken (Gallus Gallus)
  misc_feature (36): n=g or t
gatacactgggaactgaagcaattacttacattgtnaacaaaggtagggcatttctaatagttcaacaact

SEQ ID NO: 43034 - DNA, 71 bp, chicken (Gallus Gallus)
  misc_feature (36): n=c or t
gcacagaaggcaaaacccgtgctgtggtgtttctantgatgttggacgtggcttgatggcattacaggtga

SEQ ID NO: 43035 - DNA, 71 bp, chicken (Gallus Gallus)
  misc_feature (36): n=a or g
atgtgccttagaaagcaaagctcaggtgctgcgatngaaggctgcaagtgggcagaaaggccgtgcagccc

SEQ ID NO: 43036 - DNA, 71 bp, chicken (Gallus Gallus)
  misc_feature (36): n=g or t
gagagtaaacagaagaacatctttactgctaatccncaaatttgagtcattcaaagacaatagcattccac

SEQ ID NO: 43037 - DNA, 71 bp, chicken (Gallus Gallus)
  misc_feature (36): n=a or g
acaggctagcaaaggtgccttgctgtggatctgggngatgaatgtgagctttgctctcaatgtgggtcaaa

SEQ ID NO: 43038 - DNA, 71 bp, chicken (Gallus Gallus)
  misc_feature (36): n=a or g
tgctaaagccagaattccaaactgagatagcccacnggtaaaagaagtcaggagctaatataggtcttttg

SEQ ID NO: 43039 - DNA, 71 bp, chicken (Gallus Gallus)
  misc_feature (36): n=c or t
cgttccccttcctgttaatatgctcccctgaatgtntcacgtttaagtggagaggaaacatgtccacaggg

SEQ ID NO: 43040 - DNA, 71 bp, chicken (Gallus Gallus)
  misc_feature (36): n=c or t
gcctgaatttggatacagcttttattcctcaattgnactttgcttcctgggataacaagaacaagtaagtt

SEQ ID NO: 43041 - DNA, 71 bp, chicken (Gallus Gallus)
  misc_feature (36): n=a or g
catgcccttgtcctgcagcttcttatcatcatttgnttcttccattaaaggtacggctgtttgggattgat

SEQ ID NO: 43042 - DNA, 71 bp, chicken (Gallus Gallus)
  misc_feature (36): n=c or t
taaggttcttggtagatgtacattcctctggcttcnctgctaagctaaccaagagaactcttaacagtgcc

SEQ ID NO: 43043 - DNA, 71 bp, chicken (Gallus Gallus)
  misc_feature (36): n=a or c
taatgtcaaggtaatcttcagttgactcaggctagnaagtgagagctctaatttccagggcaacattatag

SEQ ID NO: 43044 - DNA, 71 bp, chicken (Gallus Gallus)
  misc_feature (36): n=c or t
cagttcttgaatcacgtgcatcttttccagtgctgnaaagaatttgactgcagttgtatcccctacagcac

SEQ ID NO: 43045 - DNA, 71 bp, chicken (Gallus Gallus)
  misc_feature (36): n=c or t
gcacgtgttatgttacatcttcagtcattttatagnatattaaaatgttgccggaaccctcagtattgaag

SEQ ID NO: 43046 - DNA, 71 bp, chicken (Gallus Gallus)
  misc_feature (36): n=c or t
aaactcatgatataaagacaaccctactgctaactntaagtccagtggtttgcacctcatgagccactttg

SEQ ID NO: 43047 - DNA, 71 bp, chicken (Gallus Gallus)
  misc_feature (36): n=a or g
gatctcacttaagatgtccacagatctaatccacangggcttgcagtcctgagaagttgtctctgcataag

SEQ ID NO: 43048 - DNA, 71 bp, chicken (Gallus Gallus)
  misc_feature (36): n=a or c
tgatttttttcctaagaagcaacacaaaaccactcngtgtatgttagtactgtgatttttgagtgctgtag

SEQ ID NO: 43049 - DNA, 71 bp, chicken (Gallus Gallus)
  misc_feature (36): n=c or t
ctgcaaaactggaaggggcagcatgaaaaggaattngcactgaggccttgctgacagcaaattgtgctgaa

SEQ ID NO: 43050 - DNA, 71 bp, chicken (Gallus Gallus)
  misc_feature (36): n=c or t
gacttcctaagcttccccaagagtccagaaatttgnccagcataaaagcaacaacctcattttccattgtt

SEQ ID NO: 43051 - DNA, 71 bp, chicken (Gallus Gallus)
  misc_feature (36): n=a or g
ctcacctgcattaccacaaaaacttttttcatgccncagtctgagtttttcttacctagttttcactcaag

SEQ ID NO: 43052 - DNA, 71 bp, chicken (Gallus Gallus)
  misc_feature (36): n=a or g
gagactaagtcatgaagaatacctgctgattcctgngtagcatgggtacttaacttacctgcatgctgtgc

SEQ ID NO: 43053 - DNA, 71 bp, chicken (Gallus Gallus)
  misc_feature (36): n=g or t
aagtagaaagtatccagaatagaacatacctgtcanaggtcagttgtgcctcaaaggtaatacatcacctc

SEQ ID NO: 43054 - DNA, 71 bp, chicken (Gallus Gallus)
  misc_feature (36): n=c or t
tttagttgaaaccgttatgcttcaaagttactgcantactgaagggggaaagcagacagaaacaagtgcat

SEQ ID NO: 43055 - DNA, 71 bp, chicken (Gallus Gallus)
  misc_feature (36): n=a or g
acttgatttcacattctatatgtttctcctctttanttcatccttttgcccatttgtcttttccatgtcta

SEQ ID NO: 43056 - DNA, 71 bp, chicken (Gallus Gallus)
  misc_feature (36): n=a or g
agagacgttccttttaatgttatgttgatgactgcnttaattacagttatattcagttcagaaggtgtttt

SEQ ID NO: 43057 - DNA, 71 bp, chicken (Gallus Gallus)
  misc_feature (36): n=c or t
tagcacaaacagtaattttgcacgcgcttgtgtcanagaaataatgttcatctttcatttgccttttctag

SEQ ID NO: 43058 - DNA, 71 bp, chicken (Gallus Gallus)
  misc_feature (36): n=a or g
ataatcaagctggaaagacatgctgaagaatgatgntactgccagcctcacaataaaatgaaagctgaata

SEQ ID NO: 43059 - DNA, 71 bp, chicken (Gallus Gallus)
  misc_feature (36): n=a or g
aaaccctgaacaccacagagctatggtagccttccnttgccagataacagggaaaatgtcactattgaata

SEQ ID NO: 43060 - DNA, 71 bp, chicken (Gallus Gallus)
  misc_feature (36): n=g or t
tgatgcaaagttgagaagcaattaaacaatggcttngctgtttttcataaagacagtggataataataaat

SEQ ID NO: 43061 - DNA, 71 bp, chicken (Gallus Gallus)
  misc_feature (36): n=a or c
gaagttaccactagacctgtactttttgtatctaanaattagatttatgcatattttgtatctcccattta

SEQ ID NO: 43062 - DNA, 71 bp, chicken (Gallus Gallus)
  misc_feature (36): n=a or g
atttttctgtgagattttccttagtgagattcttcnccaattaagatagttttttttattagagatcatgt

SEQ ID NO: 43063 - DNA, 71 bp, chicken (Gallus Gallus)
  misc_feature (36): n=c or t
tgactgccactctggaaggagtttttccctcacaancctagatccttagagaggggtgagcattcctttcc

SEQ ID NO: 43064 - DNA, 71 bp, chicken (Gallus Gallus)
  misc_feature (36): n=c or t
tcaaccttcccgtcctcacatcaagtacagaacagnccagtgtctaatcaagataaactaatcatgatgtt

SEQ ID NO: 43065 - DNA, 71 bp, chicken (Gallus Gallus)
  misc_feature (36): n=a or g
tgattcttttttttcccccctcttatctgtaaagangaaatgcatttttagtaccccaaatgtagaaagat

SEQ ID NO: 43066 - DNA, 71 bp, chicken (Gallus Gallus)
  misc_feature (36): n=a or g
atattctccaaaacacctaagctattttgcccctgnaggacattgtattcggtttcagttatgagactcag

SEQ ID NO: 43067 - DNA, 71 bp, chicken (Gallus Gallus)
  misc_feature (36): n=a or g
tgtgtgtgaatgcacactgtgccatctaaaagaacntctctgtgtttctggaaacaattgcaagtaagagc

SEQ ID NO: 43068 - DNA, 71 bp, chicken (Gallus Gallus)
  misc_feature (36): n=a or g
tagatggttgtgtacttgctgctcattttccatatnctcacatgtcccaggaaactgtattacctgtctgc

SEQ ID NO: 43069 - DNA, 71 bp, chicken (Gallus Gallus)
  misc_feature (36): n=a or c
tcatcatcagttcctcttgacttgcaaggtaatatncctgcttcacaagactgcggtctgatcttgagcag

SEQ ID NO: 43070 - DNA, 71 bp, chicken (Gallus Gallus)
  misc_feature (36): n=c or t
actgtataaaagtctcatctgtatgaattagataanattatttcacttacagatggaaaataattagagga

SEQ ID NO: 43071 - DNA, 71 bp, chicken (Gallus Gallus)
  misc_feature (36): n=c or t
gataacattcaatatgatagattattaagaatcatntttcagcagaatggatagacttcatcaattctaac

SEQ ID NO: 43072 - DNA, 71 bp, chicken (Gallus Gallus)
  misc_feature (36): n=a or g
gaaatattgtattaatttcaactaatgcaaagagcnggtcacattctaaagagtactgctgataacatcta

SEQ ID NO: 43073 - DNA, 71 bp, chicken (Gallus Gallus)
  misc_feature (36): n=c or t
aaaaagatgataataacttcattttaccagtagtgntttgagtgctgcaaatgcccattcaagatggacag

SEQ ID NO: 43074 - DNA, 71 bp, chicken (Gallus Gallus)
  misc_feature (36): n=a or g
atgtcattttcagagaaatcaattgaagcaaatttntgctgggcaagctatggcacataaagtgagactaa

SEQ ID NO: 43075 - DNA, 71 bp, chicken (Gallus Gallus)
  misc_feature (36): n=c or t
gatttataaatctcataaactagttactagaatatntatgcgtgagtgtattggcatagtttaacaacaga

SEQ ID NO: 43076 - DNA, 71 bp, chicken (Gallus Gallus)
  misc_feature (36): n=g or t
acctccatgtaaggctatctgtagtgttcaaagtgnggggcaggatatgctgaatcaaaaattgggtagtg

SEQ ID NO: 43077 - DNA, 71 bp, chicken (Gallus Gallus)
  misc_feature (36): n=c or t
gtttgttgtgaatcaactacaaggtgatgtttaccnttttgtgactgttatatttttctaaaagttaatat

SEQ ID NO: 43078 - DNA, 71 bp, chicken (Gallus Gallus)
  misc_feature (36): n=a or g
attctgtctagctttctgtccagcatcaagaaaaantatgcaaataagactttaaaaaattgtcacaaaaa

SEQ ID NO: 43079 - DNA, 71 bp, chicken (Gallus Gallus)
  misc_feature (36): n=a or g
acaagatcttgctgaaaaattttgctaaaaagtacngtaattactggttcttaacatgctctctttacaga

SEQ ID NO: 43080 - DNA, 71 bp, chicken (Gallus Gallus)
  misc_feature (36): n=g or t
tggtctttgtcgagcacagcactgtctattctggtngctcacattggaggtacagatcccagcaagcagct

SEQ ID NO: 43081 - DNA, 71 bp, chicken (Gallus Gallus)
  misc_feature (36): n=a or g
tttgttctcccactgttttgaattatgaatgagcantgagaaacatcattagatactgggggaaagtaaaa

SEQ ID NO: 43082 - DNA, 71 bp, chicken (Gallus Gallus)
  misc_feature (36): n=c or t
tcttatttcctggtgttttcatgatccatgactttnactgctggcattatcaaaaggctgccagatacata

SEQ ID NO: 43083 - DNA, 71 bp, chicken (Gallus Gallus)
  misc_feature (36): n=c or t
ctatagtctaaattgctggaaataaatgtgcaaacngtacaattattgaacaattaactttttggactgca

SEQ ID NO: 43084 - DNA, 71 bp, chicken (Gallus Gallus)
  misc_feature (36): n=a or g
atcctgacaaagcataaatccttcttttgtgttagnaaaaggaatgaaataaggtacttcactacttccat

SEQ ID NO: 43085 - DNA, 71 bp, chicken (Gallus Gallus)
  misc_feature (36): n=c or t
tcacaggagaccttcaaatggtaatatcctaatatnctttgtttattgttaacttgagataaatttaaagc

SEQ ID NO: 43086 - DNA, 71 bp, chicken (Gallus Gallus)
  misc_feature (36): n=c or t
aataggccagaagtgaatgtaagctaactttgcccnttctgtgtcacagaatgtacttgaaatgctctaca

SEQ ID NO: 43087 - DNA, 71 bp, chicken (Gallus Gallus)
  misc_feature (36): n=c or t
tatttttactctggatacgctttataatgtaaaaanattctttatactctacaaacattctgatgtacttt

SEQ ID NO: 43088 - DNA, 71 bp, chicken (Gallus Gallus)
  misc_feature (36): n=a or g
cttgtgctgctgtggatcttcaactacaataaaacntgcaaattgtgatagtttaaatctagcttaaatat

SEQ ID NO: 43089 - DNA, 71 bp, chicken (Gallus Gallus)
  misc_feature (36): n=a or g
tcctttactctgttcaggattacttgggaggattcnttttcgtctttccccctcctccaggctccttcagt

SEQ ID NO: 43090 - DNA, 71 bp, chicken (Gallus Gallus)
  misc_feature (36): n=g or t
ttaaagcttattttaatctagtctttctattcattnaagctattcaaagctgattcagagaacaggaggga

SEQ ID NO: 43091 - DNA, 71 bp, chicken (Gallus Gallus)
  misc_feature (36): n=g or t
agagaggctaaaaaggcagctgtggggcagaaaggntaagagctactgagttagattagctaatatccacc

SEQ ID NO: 43092 - DNA, 71 bp, chicken (Gallus Gallus)
  misc_feature (36): n=a or g
tgtatataaagatctgtccctgtgtgatctacctcnccaaaggatcccagacatgtcatgtgagtgctgca

SEQ ID NO: 43093 - DNA, 71 bp, chicken (Gallus Gallus)
  misc_feature (36): n=a or g
agccttaatgcttttatgatgacaactaaggaaagngctgctttctcattaagcatcctaaactaattttt

SEQ ID NO: 43094 - DNA, 71 bp, chicken (Gallus Gallus)
  misc_feature (36): n=a or g
gatttaaagctcaaggtcagtgttttgttactttangaatacaatatgctgcaggaaaaatgtaatgtgga

SEQ ID NO: 43095 - DNA, 71 bp, chicken (Gallus Gallus)
  misc_feature (36): n=a or g
gccctgctgtatatacttcctcaattttatcttgcngcaaatctgctttatggaaatatccttgtaattga

SEQ ID NO: 43096 - DNA, 71 bp, chicken (Gallus Gallus)
  misc_feature (36): n=g or t
ccaattccctgtccactctctgtaatgctgaaattnatcattcatatgtgtatgtgacctttcagttctgt

SEQ ID NO: 43097 - DNA, 71 bp, chicken (Gallus Gallus)
  misc_feature (36): n=c or t
accagtgggagcagtgtgggcgttctgtacctctgnagaaaggagacggatggatggtattccccctcctt

SEQ ID NO: 43098 - DNA, 71 bp, chicken (Gallus Gallus)
  misc_feature (36): n=a or g
agaaacagtttcgttatttgtacttgggatgaaaanaagattgaatttatcccacaaaatgttttttatga

SEQ ID NO: 43099 - DNA, 71 bp, chicken (Gallus Gallus)
  misc_feature (36): n=c or t
aaacaacacattcaaattaaaatgctccaaccaaantctatagtatctatttagcaatagatatctaaatt

SEQ ID NO: 43100 - DNA, 71 bp, chicken (Gallus Gallus)
  misc_feature (36): n=g or t
aactatttaattcctaaagatctgattgttgctaancctagtattctaggaaaggaaatattgagttcctt

SEQ ID NO: 43101 - DNA, 71 bp, chicken (Gallus Gallus)
  misc_feature (36): n=c or t
tccctaaggaaggctttcagccttgaatgttctaangctacatgatttcaattttactgacataagttttc

SEQ ID NO: 43102 - DNA, 71 bp, chicken (Gallus Gallus)
  misc_feature (36): n=c or t
ttttttataatttttgcagttaattttaagtctttngcctcatttttaagtcagtgatgagtattttgccc

SEQ ID NO: 43103 - DNA, 71 bp, chicken (Gallus Gallus)
  misc_feature (36): n=a or g
attttctaatggaagcaaactctaaaatgtataagntatcatttaaacatccagtgacagtagcataggaa

SEQ ID NO: 43104 - DNA, 71 bp, chicken (Gallus Gallus)
  misc_feature (36): n=a or g
atgtgaaagagagtacattctactgatcagttcttntctgggctctgaaggaagctgatgtacttgaccct

SEQ ID NO: 43105 - DNA, 71 bp, chicken (Gallus Gallus)
  misc_feature (36): n=a or g
taagtagaacgtttagccaaattctttgattggaantattgtatcttgagggaatctgtggtcctggattt

SEQ ID NO: 43106 - DNA, 71 bp, chicken (Gallus Gallus)
  misc_feature (36): n=c or t
ttatcctccgtgaagtattgtcatctgttttatttnggagtttaactgaactcgctgcaaggcatattgcc

SEQ ID NO: 43107 - DNA, 71 bp, chicken (Gallus Gallus)
  misc_feature (36): n=c or t
tgctccctccccgctgctctgtcttctcatgctcanggtttgcagcagtcagagcattttgataagcagac

SEQ ID NO: 43108 - DNA, 71 bp, chicken (Gallus Gallus)
  misc_feature (36): n=a or g
cacagtaaacataggaaaacatgctatacaacaaanaatccacaaaaatttaaaaaaaaaaaaaaaaaaag

SEQ ID NO: 43109 - DNA, 71 bp, chicken (Gallus Gallus)
  misc_feature (36): n=c or t
gtttggagtgctagaaagtaagtgttctttattctnggtgccagatacatgaggggatccttccacctggc

SEQ ID NO: 43110 - DNA, 71 bp, chicken (Gallus Gallus)
  misc_feature (36): n=a or g
cattacagacctgcccacattttttctgtcactgcncatctctcctgcagtttccttgaaaagacagcgat

SEQ ID NO: 43111 - DNA, 71 bp, chicken (Gallus Gallus)
  misc_feature (36): n=a or g
cagatttctgtaaaattttctagagcactgtgcatnttgaatttctgctttgtcttgagaaaagcttgcac

SEQ ID NO: 43112 - DNA, 71 bp, chicken (Gallus Gallus)
  misc_feature (36): n=a or g
caagactatggaagcatgagaggcagtaagaatggnatctgctagatagtgggctaacccagccacgggaa

SEQ ID NO: 43113 - DNA, 71 bp, chicken (Gallus Gallus)
  misc_feature (36): n=g or t
cggctccggcctgtctagagctctcgtgatttagcnccgggaatggctgctcctgagaaaacggcaacatc

SEQ ID NO: 43114 - DNA, 71 bp, chicken (Gallus Gallus)
  misc_feature (36): n=c or t
gggaactgcgggtagggaggcaggacacaggcatangacagcagtgaagttacacagataaatttttttgg

SEQ ID NO: 43115 - DNA, 71 bp, chicken (Gallus Gallus)
  misc_feature (36): n=c or t
tttaaaagaaaaaaaataaggattcttctcttgtgnaatgctaatgagtcacttactgaaatatatctgtt

SEQ ID NO: 43116 - DNA, 71 bp, chicken (Gallus Gallus)
  misc_feature (36): n=a or g
cagtgtcaataactttatgctaatgcatgatgagancaagatgtgtaagcaagacactggctttgcatcca

SEQ ID NO: 43117 - DNA, 71 bp, chicken (Gallus Gallus)
  misc_feature (36): n=a or g
tgaattgccctcaaagagcgagttgtgaaagagagnagtccaggcaggtgtccgcgataaggagacattaa

SEQ ID NO: 43118 - DNA, 71 bp, chicken (Gallus Gallus)
  misc_feature (36): n=a or g
aaactctttgttatgcagacataaatctttcccccnttgtgctcaatgacttcattactgtttgaatacat

SEQ ID NO: 43119 - DNA, 71 bp, chicken (Gallus Gallus)
  misc_feature (36): n=a or g
tctgagagtcagaggagaaaacatgatcaatagaanattgctctgatgtcagttgtgaaagttgtacagct

SEQ ID NO: 43120 - DNA, 71 bp, chicken (Gallus Gallus)
  misc_feature (36): n=a or c
caaaaaacgtagtatttaaaaaccagcatagacaanatgcttgagaagtacttattttctgtgctatagta

SEQ ID NO: 43121 - DNA, 71 bp, chicken (Gallus Gallus)
  misc_feature (36): n=a or g
ttacatctgtttttcagatcagtgatctggtttacnctcactgtactgactgactgcacagcgagggttgc

SEQ ID NO: 43122 - DNA, 71 bp, chicken (Gallus Gallus)
  misc_feature (36): n=a or g
cataaactaagagtaatgaatataatatctttcaancattttctttttctgacacctttcagtaagcaatt

SEQ ID NO: 43123 - DNA, 71 bp, chicken (Gallus Gallus)
  misc_feature (36): n=a or g
aaggtgagaagagaaaccaaaatcatgctgtgccangcatctgcaaatttgattattccagatgtgatttt

SEQ ID NO: 43124 - DNA, 71 bp, chicken (Gallus Gallus)
  misc_feature (36): n=a or g
ttcgtgcatcagctcacactgatgacaacagctgangtcccagtttctttagggattcctgtctaacaact

SEQ ID NO: 43125 - DNA, 71 bp, chicken (Gallus Gallus)
  misc_feature (36): n=a or c
aagcacactgctataacacctccatgtgctgctgcntaagaactgccatgaattcctaatgatttgcacta

SEQ ID NO: 43126 - DNA, 71 bp, chicken (Gallus Gallus)
  misc_feature (36): n=c or t
catttgaaaacagcaagaaatatcgctcttctttcncctgccaggacaagaatggaggttaggccagtctg

SEQ ID NO: 43127 - DNA, 71 bp, chicken (Gallus Gallus)
  misc_feature (36): n=c or t
aaattcaggtgaaatgttgcacagtgaggcaagttngatctcagctgggttttccatagttgtatcacaga

SEQ ID NO: 43128 - DNA, 71 bp, chicken (Gallus Gallus)
  misc_feature (36): n=a or g
tgcgagggatcactgcaatggtaggtaggacagagnatgctatgcctaatgttcccttttcaggctgtggt

SEQ ID NO: 43129 - DNA, 71 bp, chicken (Gallus Gallus)
  misc_feature (36): n=c or t
tgcataaaatccaaaaattacaagaagtttaaaatncttctgcaaagttgttccctcttggccaaagcaaa

SEQ ID NO: 43130 - DNA, 71 bp, chicken (Gallus Gallus)
  misc_feature (36): n=a or c
cagggtggctggaccttgctctctgatacatgatcnccttctacaaattcttgctctgctttcaggagtcc

SEQ ID NO: 43131 - DNA, 71 bp, chicken (Gallus Gallus)
  misc_feature (36): n=c or t
tgagtgtctcactaaaagcttacttaaatagtgtcnttctactctgtggatgatttgtcaaatttgcctgc

SEQ ID NO: 43132 - DNA, 71 bp, chicken (Gallus Gallus)
  misc_feature (36): n=c or t
tacatgtgtttttggttacgactaggggaattgcantagcttcattgtcttaagaacagacccagaccttg

SEQ ID NO: 43133 - DNA, 71 bp, chicken (Gallus Gallus)
  misc_feature (36): n=a or c
acctcttcctggaggctcatcatggctcctttgaanaaatccaggcttgttattctttttgttggaaagca

SEQ ID NO: 43134 - DNA, 71 bp, chicken (Gallus Gallus)
  misc_feature (36): n=c or t
ttttatctgaaagatttctggtctgcttaagctttnttttccatgtaatggatacagcacccagaagaacc

SEQ ID NO: 43135 - DNA, 71 bp, chicken (Gallus Gallus)
  misc_feature (36): n=a or g
gatatgtttcaagatgctcagacatactgcgggagnttcttctgcccctttgtagcaatgacactgatggt

SEQ ID NO: 43136 - DNA, 71 bp, chicken (Gallus Gallus)
  misc_feature (36): n=g or t
tgatagaaagaaaacaaaccatggctgacaggacancagtgttgcttctgccaactcatcaaaggccagta

SEQ ID NO: 43137 - DNA, 71 bp, chicken (Gallus Gallus)
  misc_feature (36): n=c or t
aaggtcactgttcagaaaatgtgttggttgcgcaanacatcacagtcttatggccaattatttggagctgc

SEQ ID NO: 43138 - DNA, 71 bp, chicken (Gallus Gallus)
  misc_feature (36): n=a or g
cactgctcttcccattttgagttatgatacgctacnccgaatcaacattgaagcaaacactgtctctcagc

SEQ ID NO: 43139 - DNA, 71 bp, chicken (Gallus Gallus)
  misc_feature (36): n=a or c
gtttttgtagcatagatgtgtgacctttgtagatgngctgagatccaaacacgcacccgaggagcagcgtt

SEQ ID NO: 43140 - DNA, 71 bp, chicken (Gallus Gallus)
  misc_feature (36): n=c or t
tgttccagcagtccccgcagtaccctgatggccgcnttcagctttgttccgcagtacttgccgccagggag

SEQ ID NO: 43141 - DNA, 71 bp, chicken (Gallus Gallus)
  misc_feature (36): n=c or t
cagtgacccgttttttccagtgactcagtacctggnagatgatcttctgatgtggccttcttgatgtgcag

SEQ ID NO: 43142 - DNA, 71 bp, chicken (Gallus Gallus)
  misc_feature (36): n=c or t
tgataaatcaccctgttggatcctctgtggccatcngacagcagcagcacttgttgctcctgtaggtccct

SEQ ID NO: 43143 - DNA, 71 bp, chicken (Gallus Gallus)
  misc_feature (36): n=a or g
caacccaaaaagctcaggctccggtaccctttgagnccttattttcaaatccacacaggtttgagtgtacg

SEQ ID NO: 43144 - DNA, 71 bp, chicken (Gallus Gallus)
  misc_feature (36): n=c or t
atacaccttccacggagcagcattgtgcctgactcngagtttattcccttttgtgagtttgtgacacgctc

SEQ ID NO: 43145 - DNA, 71 bp, chicken (Gallus Gallus)
  misc_feature (36): n=a or g
gtttttttttcttgacttataatacaccactcacangcaaagtaactggaatttggatgtaaacataattt

SEQ ID NO: 43146 - DNA, 71 bp, chicken (Gallus Gallus)
  misc_feature (36): n=c or t
ggatggaggcctttctgaggaatgctcagctttagnagactggaaaaaccaagttttggtcacaggaacgg

SEQ ID NO: 43147 - DNA, 71 bp, chicken (Gallus Gallus)
  misc_feature (36): n=a or g
accccaagcatacaaataggtgatgaatgttaagcngaaggcagttgcattcatcactgatcatcagtgaa

SEQ ID NO: 43148 - DNA, 71 bp, chicken (Gallus Gallus)
  misc_feature (36): n=c or t
cctagggaagtcatttacttctggaagtactgactnccagctcccactgtagttgcaattgtgtcatttaa

SEQ ID NO: 43149 - DNA, 71 bp, chicken (Gallus Gallus)
  misc_feature (36): n=c or t
catagatagtgcctttaagtgcctcaacttgaaaanggagctgacattgaagtccattgtaagtacatata

SEQ ID NO: 43150 - DNA, 71 bp, chicken (Gallus Gallus)
  misc_feature (36): n=a or c
gtccacatgggcatacttgtgtcagctttttgtgcnaggttactgacatggcagcatgcctgcatgcgtgc

SEQ ID NO: 43151 - DNA, 71 bp, chicken (Gallus Gallus)
  misc_feature (36): n=a or g
cagacccaagggtgcattgctctctaatgtcccttncaaaacaaagtttatccattctctgactatgtgta

SEQ ID NO: 43152 - DNA, 71 bp, chicken (Gallus Gallus)
  misc_feature (36): n=a or g
gaaggataagcagtgacctgttatgaaacttttaanaagatgaaacaatgtttctgagaaccacaacacca

SEQ ID NO: 43153 - DNA, 71 bp, chicken (Gallus Gallus)
  misc_feature (36): n=a or g
tgcatagtactgaaatggaacaaaaacctctttcantgttcccctcaaaaggcagactgaacgtgatcacg

SEQ ID NO: 43154 - DNA, 71 bp, chicken (Gallus Gallus)
  misc_feature (36): n=c or t
tagaaattatactgctgctgaccttcttagttttgntttcgtaaatgtaatctggatgctttgctagcgtg

SEQ ID NO: 43155 - DNA, 71 bp, chicken (Gallus Gallus)
  misc_feature (36): n=a or g
acgagactgcttgcaattctgttgttacaatttacntgtcatatagcttaattttgcactgggacaaatga

SEQ ID NO: 43156 - DNA, 71 bp, chicken (Gallus Gallus)
  misc_feature (36): n=a or c
ccaggatcgcagagagtgccaggaagaaatgatatnaatgcctggtctgttaaggttaaatgaagttgcat

SEQ ID NO: 43157 - DNA, 71 bp, chicken (Gallus Gallus)
  misc_feature (36): n=a or g
gtcaactaacctgctcgattgcattctgtgaatgcnaggagaagtaatagtatgtatttcatcctgtttcc

SEQ ID NO: 43158 - DNA, 71 bp, chicken (Gallus Gallus)
  misc_feature (36): n=c or t
tttttttttttttttttctgtccccaaggccttttnttttaacatctgaagcaagaagttggactttttag

SEQ ID NO: 43159 - DNA, 71 bp, chicken (Gallus Gallus)
  misc_feature (36): n=a or g
tcagcctgagaggtgaatcttatggaaaattacaanctgcagaggataaggagttataatggaaatccttt

SEQ ID NO: 43160 - DNA, 71 bp, chicken (Gallus Gallus)
  misc_feature (36): n=a or g
tttagccaatgctgctgttttccagaggtgaccgantccatctgttctttgcagatgatactgaaggccac

SEQ ID NO: 43161 - DNA, 71 bp, chicken (Gallus Gallus)
  misc_feature (36): n=a or g
acaatctacgttaaagcagccactacctttggtatntacaaaggcagaactttgctattccccagaatatt

SEQ ID NO: 43162 - DNA, 71 bp, chicken (Gallus Gallus)
  misc_feature (36): n=g or t
gtgagattccgggaaatgcgttccagaaccacttcngtggggcctgggcaggaaaagggtccggtgagctc

SEQ ID NO: 43163 - DNA, 71 bp, chicken (Gallus Gallus)
  misc_feature (36): n=a or g
ctgctctgaaaacacctggggggttaccagctgagnccaaagaggcagaatgggctggaggaatgcagttc

SEQ ID NO: 43164 - DNA, 71 bp, chicken (Gallus Gallus)
  misc_feature (36): n=a or g
ggtgtatgatttcacaagagccttccataagctgtncggagcagtgacacctttaacaaccataaagactg

SEQ ID NO: 43165 - DNA, 71 bp, chicken (Gallus Gallus)
  misc_feature (36): n=a or g
cataaaacagctacaaagtaccactgtcattaacancagagaatatatccacatacaggaaacattttggg

SEQ ID NO: 43166 - DNA, 71 bp, chicken (Gallus Gallus)
  misc_feature (36): n=a or g
aaggcaatgcggtgacccacctgacattcagagganttttgtaacagcagtcaaagagagggtagtccagg

SEQ ID NO: 43167 - DNA, 71 bp, chicken (Gallus Gallus)
  misc_feature (36): n=a or g
tccaaatttcctcaattgttgaggataataaagtcnttctctctagcataaaccggtgctaatcccatgtt

SEQ ID NO: 43168 - DNA, 71 bp, chicken (Gallus Gallus)
  misc_feature (36): n=c or t
tccttttctaactcatggagaagcacacaaatgcangcttttacagtacaattagcagtaatgaaaataaa

SEQ ID NO: 43169 - DNA, 71 bp, chicken (Gallus Gallus)
  misc_feature (36): n=c or t
gagtccattatactgagcacaaggaaatgctactgntagagttatgggaggatttgctcattaaaaaaaat

SEQ ID NO: 43170 - DNA, 71 bp, chicken (Gallus Gallus)
  misc_feature (36): n=a or g
ctgcatttccagctgtgtcccagagttgatggcagncagggctcctgtagaacacttactcttccaaacaa

SEQ ID NO: 43171 - DNA, 71 bp, chicken (Gallus Gallus)
  misc_feature (36): n=a or g
tgaaaatcagtctgtgagatcctttaagatcttcanagtaatgagatctgtcatataatgttttcctttac

SEQ ID NO: 43172 - DNA, 71 bp, chicken (Gallus Gallus)
  misc_feature (36): n=a or c
agcacatatccttgacagtccgtctgttagatgtanccaagatatctgcagctggggctttacaacttgaa

SEQ ID NO: 43173 - DNA, 71 bp, chicken (Gallus Gallus)
  misc_feature (36): n=a or g
ataacatactcaggccattcctgccctcggagcctngaacaatattcttccctcacagaagttcacaggtt

SEQ ID NO: 43174 - DNA, 71 bp, chicken (Gallus Gallus)
  misc_feature (36): n=c or t
aaagctagctgaaacaatctaatcactaagtagctngacaaatgattgaagcatttgctgactagcacatt

SEQ ID NO: 43175 - DNA, 71 bp, chicken (Gallus Gallus)
  misc_feature (36): n=a or g
tactgttgtagagcacttttggtgcagttcctcctnggtttgcaaagctgtttgcagagtggaatggctca

SEQ ID NO: 43176 - DNA, 71 bp, chicken (Gallus Gallus)
  misc_feature (36): n=c or t
gacagatcaaacactgtgagcttcttacaaaactgnagctaactcatggtgttgtgaaagccaaactaata

SEQ ID NO: 43177 - DNA, 71 bp, chicken (Gallus Gallus)
  misc_feature (36): n=c or t
caatgcactgttcaagtgtttgagtaactactgtantcagcattcagattctgtttcctcatgtccatact

SEQ ID NO: 43178 - DNA, 71 bp, chicken (Gallus Gallus)
  misc_feature (36): n=a or g
gacattttaaaaacataacatttgtgtacagaagtnttagaatattgtacatgatgctgaaaagcagaatt

SEQ ID NO: 43179 - DNA, 71 bp, chicken (Gallus Gallus)
  misc_feature (36): n=c or t
aataggctgtggttatgaattatgaacgctgttgtncaggcctctgcttctgacttctgtgataatatggg

SEQ ID NO: 43180 - DNA, 71 bp, chicken (Gallus Gallus)
  misc_feature (36): n=c or t
tgcgggaagtgctagtttggtctggcaaaacaaaanctgaggaagtatcatctatgtaaacatcttacata

SEQ ID NO: 43181 - DNA, 71 bp, chicken (Gallus Gallus)
  misc_feature (36): n=a or g
aatttcagaagggaagtagttgtttgatttaccacntattttgggcatgcaagttgaaaagcatgcttgat

SEQ ID NO: 43182 - DNA, 71 bp, chicken (Gallus Gallus)
  misc_feature (36): n=c or t
gtctgaatacttagaggatgcttttcctaaaaggcnggaaaacaaagttccagtccagttatccctctatt

SEQ ID NO: 43183 - DNA, 71 bp, chicken (Gallus Gallus)
  misc_feature (36): n=c or t
tcaaatcctctttcagcaacttcttggagaacatangatattgaagctctggagtctcctaatgttaactt

SEQ ID NO: 43184 - DNA, 71 bp, chicken (Gallus Gallus)
  misc_feature (36): n=a or g
agttgtaaagtaattttgtcatcattttgctgactnagacagcagcatgttatatttctgttcctcttgtc

SEQ ID NO: 43185 - DNA, 71 bp, chicken (Gallus Gallus)
  misc_feature (36): n=g or t
gtgtaaggcatgttcacccattctgtgttgcttaanttatgtttgagaaatattgggggtgggggaagatg

SEQ ID NO: 43186 - DNA, 71 bp, chicken (Gallus Gallus)
  misc_feature (36): n=a or g
ctcccctccaatgaaggagcccatttcccataaagnatccctaaggaagggagagtaatgatggttataat

SEQ ID NO: 43187 - DNA, 71 bp, chicken (Gallus Gallus)
  misc_feature (36): n=c or t
taactgcagccacgtgcctttcatcttgcattaagnctttcctgtggtctttaaatatagctgtgatcaat

SEQ ID NO: 43188 - DNA, 71 bp, chicken (Gallus Gallus)
  misc_feature (36): n=a or g
attcttgagagcagaaccccatcaaagacagtttcntgtgactacctcctctggctcaagcaattccctat

SEQ ID NO: 43189 - DNA, 71 bp, chicken (Gallus Gallus)
  misc_feature (36): n=c or t
ataatgcctctggaaattttggacaggatttctcangatggtaattaagcttcccacagttaagtttctct

SEQ ID NO: 43190 - DNA, 71 bp, chicken (Gallus Gallus)
  misc_feature (36): n=c or t
ttttgtgattctgtcagctccatttttctcttaagngtaaaagacccacctcagcacagccagaaagccac

SEQ ID NO: 43191 - DNA, 71 bp, chicken (Gallus Gallus)
  misc_feature (36): n=c or t
aagtggcagaaactgcctactttatctatcactcangctatttctgtggggagatgcttgctagtcaactc

SEQ ID NO: 43192 - DNA, 71 bp, chicken (Gallus Gallus)
  misc_feature (36): n=a or g
tgggagttttgtggagacatggcacaagtgtgtgtnaagagtccttctgggtgagctgcaagctgtggatc

SEQ ID NO: 43193 - DNA, 71 bp, chicken (Gallus Gallus)
  misc_feature (36): n=a or g
tttatccttgcaagccgcactgtgaggcagggaagngctgttctccatattgtgctagacaaactggattg

SEQ ID NO: 43194 - DNA, 71 bp, chicken (Gallus Gallus)
  misc_feature (36): n=c or t
aaaaaggatgcactgtgcaggtttttcagtgcatgntgaatgtttttcatccctgttgtaggaactgacat

SEQ ID NO: 43195 - DNA, 71 bp, chicken (Gallus Gallus)
  misc_feature (36): n=c or t
gatcagacataaactgaggtgcccaagactgcctancagcctcaatacaataatctgatttacttagaagc

SEQ ID NO: 43196 - DNA, 71 bp, chicken (Gallus Gallus)
  misc_feature (36): n=c or t
cccactggcacgcatacagcatactggggaggctgngtatttccatctggcctagttcctgtgtaaaatac

SEQ ID NO: 43197 - DNA, 71 bp, chicken (Gallus Gallus)
  misc_feature (36): n=a or g
aggagaaggtgaatcatctgcactgaagcactgagnaatgcacacgagtctttcaaatcacagctctgtgt

SEQ ID NO: 43198 - DNA, 71 bp, chicken (Gallus Gallus)
  misc_feature (36): n=a or c
atagaatgatttgacagcaagtgagaagaagtgggntgagtactgtcagagcaagctgtgggcaggaaatc

SEQ ID NO: 43199 - DNA, 71 bp, chicken (Gallus Gallus)
  misc_feature (36): n=a or g
tgtttggtgacaatttggccccccaaatcttcaacntttacttcctcaatggaatttggactgcaaatctg

SEQ ID NO: 43200 - DNA, 71 bp, chicken (Gallus Gallus)
  misc_feature (36): n=c or t
caccgagatacaaatctccttgacgggacttcaagntggcaaaagtacacacgccgcagtgcaacccatac

SEQ ID NO: 43201 - DNA, 71 bp, chicken (Gallus Gallus)
  misc_feature (36): n=c or t
gtgacacactcagacaacagcctcccacaggagctnacttgggtgctgccatcagggacatgtgggcacac

SEQ ID NO: 43202 - DNA, 71 bp, chicken (Gallus Gallus)
  misc_feature (36): n=c or t
gaacatatgcccatggcttccccatcaccacagccnagtgatctttcagcacttaggacctttttcgtttt

SEQ ID NO: 43203 - DNA, 71 bp, chicken (Gallus Gallus)
  misc_feature (36): n=g or t
cagctttcttcagtctgagcaccactacagatcacntcagtggattctccaccagtactatctggacagca

SEQ ID NO: 43204 - DNA, 71 bp, chicken (Gallus Gallus)
  misc_feature (36): n=a or g
actgattgtaacgctggggcacacagagtttctccncaaagctttcctcctcaggctaacaaggcacagaa

SEQ ID NO: 43205 - DNA, 71 bp, chicken (Gallus Gallus)
  misc_feature (36): n=a or g
aggtgttaggttagcagtggattgagctattcggcntagcaggatgttggtgtcagtgctgcttgaatatg

SEQ ID NO: 43206 - DNA, 71 bp, chicken (Gallus Gallus)
  misc_feature (36): n=c or t
ccctgctgaaggcaaagcagttgatcaatttcacanggataaactgataggacacagtgaagggttggttg

SEQ ID NO: 43207 - DNA, 71 bp, chicken (Gallus Gallus)
  misc_feature (36): n=a or g
tactattcaatagtcactacttcgattacgattcantagtcactactacacagatttaagttgttggtctt

SEQ ID NO: 43208 - DNA, 71 bp, chicken (Gallus Gallus)
  misc_feature (36): n=a or g
ctgggaactggtacttgtttaggagagcaatgctcntaaatttgagaactgtgaaatagcagaggtggttt

SEQ ID NO: 43209 - DNA, 71 bp, chicken (Gallus Gallus)
  misc_feature (36): n=c or t
aaacactgaattctcgactacgtgttccattgtaanacacaggaacatccacacagaaaagctttcacctt

SEQ ID NO: 43210 - DNA, 71 bp, chicken (Gallus Gallus)
  misc_feature (36): n=c or t
tctgaagtcctctgtgtcacttcagcccattgatantgttagaacttgtttttctgaaaggtttatactgg

SEQ ID NO: 43211 - DNA, 71 bp, chicken (Gallus Gallus)
  misc_feature (36): n=c or t
ttttcttttgtctgttctgaatcttacctctttgantttccgataagccaaaattgaactatttcactggt

SEQ ID NO: 43212 - DNA, 71 bp, chicken (Gallus Gallus)
  misc_feature (36): n=a or g
agagaagtgtttgaatcagcagagtttagcaagtgntactgtcccttctagaggcattttggtcagcagaa

SEQ ID NO: 43213 - DNA, 71 bp, chicken (Gallus Gallus)
  misc_feature (36): n=c or t
ttacagcaaaatccatagcatgtgagacacctccanaggtgacaattccctgatcatcacaagacagagca

SEQ ID NO: 43214 - DNA, 71 bp, chicken (Gallus Gallus)
  misc_feature (36): n=a or g
atttgggcactaacaactatcacgctgttatgactngcacagaagttaaaatgatatctaacaaaatagga

SEQ ID NO: 43215 - DNA, 71 bp, chicken (Gallus Gallus)
  misc_feature (36): n=g or t
caaaccaaacctgagggaggaacttaccaagaaaangaggagaagcctcgtcttcttggataaacacatgt

SEQ ID NO: 43216 - DNA, 71 bp, chicken (Gallus Gallus)
  misc_feature (36): n=a or g
gaccatgtggctctgaggtcaaattccagatacaantaagtatggtgctgaataaacaaggaacatgaaaa

SEQ ID NO: 43217 - DNA, 71 bp, chicken (Gallus Gallus)
  misc_feature (36): n=a or c
agtgttttattctaaaatctattcctaacattgacnagaaagaaatcagttcagcacttctgaatgttctt

SEQ ID NO: 43218 - DNA, 71 bp, chicken (Gallus Gallus)
  misc_feature (36): n=a or g
aaagtcaagattgtgcatgcttcctataagtaaagnaacagttaggtccgctagaacgatttatcatatta

SEQ ID NO: 43219 - DNA, 71 bp, chicken (Gallus Gallus)
  misc_feature (36): n=a or g
gttcttcttaacatgatggaagtacttgctaagcantaagtcagaatacaaaaacatccccctgaaactca

SEQ ID NO: 43220 - DNA, 71 bp, chicken (Gallus Gallus)
  misc_feature (36): n=c or t
aacacagtgatatacatctgagacctggcaaaaccnagccatctacttggggcattaatttcttacttagg

SEQ ID NO: 43221 - DNA, 71 bp, chicken (Gallus Gallus)
  misc_feature (36): n=c or t
gaggaatcaaacacagatgcagctcaaagaccacantgatgcaaaaatattctttaacggcctgagtgtct

SEQ ID NO: 43222 - DNA, 71 bp, chicken (Gallus Gallus)
  misc_feature (36): n=c or t
gggcagagcaactcatgttgacatactgagccaggntcttgttaactactgggagggaaatatgcctctgc

SEQ ID NO: 43223 - DNA, 71 bp, chicken (Gallus Gallus)
  misc_feature (36): n=c or t
ggggtcaacctgagtccaaatgcttgtcatccaaancacaatttagcctaacattctagcaggtccgagtc

SEQ ID NO: 43224 - DNA, 71 bp, chicken (Gallus Gallus)
  misc_feature (36): n=c or t
gtaactggtgagtgtgattctgttgtggaagccttntggaacaagaacaatccctttggtttacatttgca

SEQ ID NO: 43225 - DNA, 71 bp, chicken (Gallus Gallus)
  misc_feature (36): n=a or g
tttttgtgacctttgaccctggagctagtgatgagncgtttaggggataagggaattttattgtaggattg

SEQ ID NO: 43226 - DNA, 71 bp, chicken (Gallus Gallus)
  misc_feature (36): n=a or g
cttgtagaagacattagtagtactagataagactgnaaaatattctgagtctgaaaatgggaaaaggcaat

SEQ ID NO: 43227 - DNA, 71 bp, chicken (Gallus Gallus)
  misc_feature (36): n=c or t
ctacttaagaaaatagtgcattaggtctggcatgtngataccggcattttatctgggttgctgacagcatc

SEQ ID NO: 43228 - DNA, 71 bp, chicken (Gallus Gallus)
  misc_feature (36): n=c or t
agtgattagcaacacagatggctcagaagtaatacntgtgtgcttacactgaaatgacaaaagcctctcca

SEQ ID NO: 43229 - DNA, 71 bp, chicken (Gallus Gallus)
  misc_feature (36): n=c or t
gaactgttcagcagccttcgtcatgaaggactcagntaactctgtgttcttgtgctgagcactaaaaagta

SEQ ID NO: 43230 - DNA, 71 bp, chicken (Gallus Gallus)
  misc_feature (36): n=a or g
ctgcatggatgctctgggcgccggtcattgcacttncacgcatctcctcgcctgctccttcccttgctgtg

SEQ ID NO: 43231 - DNA, 71 bp, chicken (Gallus Gallus)
  misc_feature (36): n=c or t
agtatgaggtaacggggacctaaatgaatctttcanggcaaacagcagtttactgaatgcgtggttgcttt

SEQ ID NO: 43232 - DNA, 71 bp, chicken (Gallus Gallus)
  misc_feature (36): n=a or g
accctcttcctgcagagtccccaaatctctgtgctntgtccctcctgtagaggaactgaactattccagaa

SEQ ID NO: 43233 - DNA, 71 bp, chicken (Gallus Gallus)
  misc_feature (36): n=a or g
agaaggcaggtgtcttctgagatgaaacacttgcantaacaattctgtgtctttaaattcaaggtcagggc

SEQ ID NO: 43234 - DNA, 71 bp, chicken (Gallus Gallus)
  misc_feature (36): n=g or t
aggagagttctaacaaggagtcataaagagcacagnggcagccagcacagtcagcaggataacaatcccag

SEQ ID NO: 43235 - DNA, 71 bp, chicken (Gallus Gallus)
  misc_feature (36): n=g or t
atttctggtatttctgtctgtaagtttttttgatanatacatctgtgctgaaatagcccacatgtttccaa

SEQ ID NO: 43236 - DNA, 71 bp, chicken (Gallus Gallus)
  misc_feature (36): n=c or t
ataccatggtgtatctttaatgccactggaaagacncatttgattaaccgcaaagcaaccatttgaccatt

SEQ ID NO: 43237 - DNA, 71 bp, chicken (Gallus Gallus)
  misc_feature (36): n=c or t
tgcagttgagcttttagttactgatttccacagtanagcccttatttaatagggatgacctgctgttttag

SEQ ID NO: 43238 - DNA, 71 bp, chicken (Gallus Gallus)
  misc_feature (36): n=c or t
tcgcattcattcagcagctgggtcaagtttaaaaanctgtctctcaggtgaatggccgatggcctttacaa

SEQ ID NO: 43239 - DNA, 71 bp, chicken (Gallus Gallus)
  misc_feature (36): n=c or t
tgacgcggggaggcattgctctcactctgatcatgntgcttttgaagaattccaaaagatgctttctcagt

SEQ ID NO: 43240 - DNA, 71 bp, chicken (Gallus Gallus)
  misc_feature (36): n=c or t
aaaaggtcagaggaagttacctgtttcatttaagantgaatcaacctttgtttgcacagagaacagaaaac

SEQ ID NO: 43241 - DNA, 71 bp, chicken (Gallus Gallus)
  misc_feature (36): n=a or g
cacagcaaatgcacaattgctctagcagaatgcttnaggcatttaccaagtaactgcagactgctttggac

SEQ ID NO: 43242 - DNA, 71 bp, chicken (Gallus Gallus)
  misc_feature (36): n=a or g
gatcagcgagtatattacatacttctgcagcttgantgtgcctggaaactgaaaagataatacagttaatc

SEQ ID NO: 43243 - DNA, 71 bp, chicken (Gallus Gallus)
  misc_feature (36): n=c or t
tgtccatgactatacctctagaatgtatgtgccttnctctttcttcctgttaccattttaatggttctcct

SEQ ID NO: 43244 - DNA, 71 bp, chicken (Gallus Gallus)
  misc_feature (36): n=c or t
ttctgttctctgtccagacatgggatatgaatgacnggaaaagaaaaggtggtgcctagtaagcagaatag

SEQ ID NO: 43245 - DNA, 71 bp, chicken (Gallus Gallus)
  misc_feature (36): n=c or t
ataaagacatactcagggatttctggaggcaaaaanaaatagtgtccttatgcagtaataagtgaataaga

SEQ ID NO: 43246 - DNA, 71 bp, chicken (Gallus Gallus)
  misc_feature (36): n=a or g
cagtcctggagtacagaaggtgcaatccaggtgacntgagctatgtagggatagagtatgcctggtgcaca

SEQ ID NO: 43247 - DNA, 71 bp, chicken (Gallus Gallus)
  misc_feature (36): n=a or g
ccaagtcaacctttgccaatggacactgacttaccntatctaatgcctgtcttatacaaccttgtggttta

SEQ ID NO: 43248 - DNA, 71 bp, chicken (Gallus Gallus)
  misc_feature (36): n=c or t
gatgaatatgtaaaaattttgatgtggattacatangttattacattatatgttggatctgttagcagaat

SEQ ID NO: 43249 - DNA, 71 bp, chicken (Gallus Gallus)
  misc_feature (36): n=c or t
tagatagctaaatgcgcagaatacttttgtttcttngttaattttagtgtaaactattgcttagtttatgt

SEQ ID NO: 43250 - DNA, 71 bp, chicken (Gallus Gallus)
  misc_feature (36): n=a or g
ctgtcaaccagatttttctgtatggagcctgaatcntaggcagattgaagcacaaaggatgattcagaatt

SEQ ID NO: 43251 - DNA, 71 bp, chicken (Gallus Gallus)
  misc_feature (36): n=a or g
aaacgcttttacagcggtcacaaagaaaatacagcnaggtcttccctcctccagacctctccccctcccct

SEQ ID NO: 43252 - DNA, 71 bp, chicken (Gallus Gallus)
  misc_feature (36): n=a or g
cttccagtgctagtggaatagtaatatttaaagacntgtggaagaataatatttaaaggcaagtaggcagc

SEQ ID NO: 43253 - DNA, 71 bp, chicken (Gallus Gallus)
  misc_feature (36): n=a or g
tgacatccagctgagtttgagaggaaaagggacatnaggatttttatggtattatgatattttcatggtgt

SEQ ID NO: 43254 - DNA, 71 bp, chicken (Gallus Gallus)
  misc_feature (36): n=a or c
agagctgggagaaacactcagcaactgctgccccanaggcacagcagaaggctcctattccttttagcatg

SEQ ID NO: 43255 - DNA, 71 bp, chicken (Gallus Gallus)
  misc_feature (36): n=c or t
atttcaaatcaattcatcactccaccagcagctttncctgccagaacacagagttcaggtgctggtagctg

SEQ ID NO: 43256 - DNA, 71 bp, chicken (Gallus Gallus)
  misc_feature (36): n=a or g
ctaggcttagattgggtactgcagtcttatctactngaaagaaaaatcccttttcagaaagagtggtgagg

SEQ ID NO: 43257 - DNA, 71 bp, chicken (Gallus Gallus)
  misc_feature (36): n=a or g
cagtaactgtttcctgtcatatggggctgggcaacngtacacacagggcaaaaacattgttacttatatgg

SEQ ID NO: 43258 - DNA, 71 bp, chicken (Gallus Gallus)
  misc_feature (36): n=c or t
ctataatggatcaatgagaaagtttgcttcagaaanttgtactaagcaacacactgtgagaggacttctgg

SEQ ID NO: 43259 - DNA, 71 bp, chicken (Gallus Gallus)
  misc_feature (36): n=a or g
ggctaaaatcgctttccaattagagtttggaatagntggtgagcactgacctggcaaaagaattagttccc

SEQ ID NO: 43260 - DNA, 71 bp, chicken (Gallus Gallus)
  misc_feature (36): n=c or t
tgaacgtagagtacaacccatagaatttaggtgctnacccatcccctggtttgctttgcccatgctttcca

SEQ ID NO: 43261 - DNA, 71 bp, chicken (Gallus Gallus)
  misc_feature (36): n=a or g
aataatcgtgcaggaactctcgtaatgacacttcantcgtcagatcccgatctccctccaaaccaaggccc

SEQ ID NO: 43262 - DNA, 71 bp, chicken (Gallus Gallus)
  misc_feature (36): n=a or g
cagcatgaaaataaatggggctgggatagaaacaancattcattttgacagagctgtggcataaaacagat

SEQ ID NO: 43263 - DNA, 71 bp, chicken (Gallus Gallus)
  misc_feature (36): n=a or g
aaaagagattgattgttcaaaaaaagttattctganccatgtttcaataggaccagctaacatgctaggac

SEQ ID NO: 43264 - DNA, 71 bp, chicken (Gallus Gallus)
  misc_feature (36): n=a or g
ggagatttgggctcaataaaccaattcttgcatgantcatctttggttatgagattctggcattttttctg

SEQ ID NO: 43265 - DNA, 71 bp, chicken (Gallus Gallus)
  misc_feature (36): n=c or t
tggagctgagcaaaataagaagtttgttctgaaacntgtttgaggtattcatatacacatctgcatatata

SEQ ID NO: 43266 - DNA, 71 bp, chicken (Gallus Gallus)
  misc_feature (36): n=a or c
ctttgggtgcctgagcagcactgtccctcattgccnagagtttgctaaagcacagcttacactcagcagtg

SEQ ID NO: 43267 - DNA, 71 bp, chicken (Gallus Gallus)
  misc_feature (36): n=a or g
atttatttctaagtagcatttataaggttgtgttcntgaaatgaatttctagagtaacttaaataattaat

SEQ ID NO: 43268 - DNA, 71 bp, chicken (Gallus Gallus)
  misc_feature (36): n=a or g
tagtgatcaacctcaaattccctttgtgaaggtaancgttacctctgtttacgtggagaaaataaggcaca

SEQ ID NO: 43269 - DNA, 71 bp, chicken (Gallus Gallus)
  misc_feature (36): n=c or t
ggcactggccctgcaccatgggaccccatactgaanactgctaagcagcaattaggtttaatcctggaatt

SEQ ID NO: 43270 - DNA, 71 bp, chicken (Gallus Gallus)
  misc_feature (36): n=a or g
ggctgagggtactctacatttaccacatctagcacnaacagtaaatctctgtgtgatggaaagcaaggcta

SEQ ID NO: 43271 - DNA, 71 bp, chicken (Gallus Gallus)
  misc_feature (36): n=c or t
tattatcagtgggtcaaatcaacctacagaaaagtncaaaaaaagtccaataactttctagggggcaaacc

SEQ ID NO: 43272 - DNA, 71 bp, chicken (Gallus Gallus)
  misc_feature (36): n=c or t
tgtgatttgagttagacaggaaatgcttttcgtcantggtatgctgttgtgtgctttttaactttaattgg

SEQ ID NO: 43273 - DNA, 71 bp, chicken (Gallus Gallus)
  misc_feature (36): n=a or g
tcaaaatgccagttatgcagtttcctttcataactnaactgttgtgatattgcgtgttgtatacagcagat

SEQ ID NO: 43274 - DNA, 71 bp, chicken (Gallus Gallus)
  misc_feature (36): n=a or g
tgagggtgtctaatacgagaggctgatactgacaantgggagacagcaggttattcggggagggaaaatca

SEQ ID NO: 43275 - DNA, 71 bp, chicken (Gallus Gallus)
  misc_feature (36): n=a or c
aataacttccagggagtacaatgggtgggaaggggnacaaatccctctctatcccgtataattcaattacc

SEQ ID NO: 43276 - DNA, 71 bp, chicken (Gallus Gallus)
  misc_feature (36): n=c or t
atgttttaccacttatgcaatgttatctccagatgntgcctctctggggaagctgattttgctcccatggt

SEQ ID NO: 43277 - DNA, 71 bp, chicken (Gallus Gallus)
  misc_feature (36): n=g or t
ttaatttatgtggctatctttcagcatctaattttncttcacctatatttcaaagatgtcttagaaagctg

SEQ ID NO: 43278 - DNA, 71 bp, chicken (Gallus Gallus)
  misc_feature (36): n=c or t
ttgttgtgcatcaccacgtcacgttgtgcatcttcnttatctcagcttatgcatcatccctgtgtcagact

SEQ ID NO: 43279 - DNA, 71 bp, chicken (Gallus Gallus)
  misc_feature (36): n=a or g
aatacagactaaatttccatgtattactacaatacnaaagtcttcgtatgtgcaaaactcagaattgaaga

SEQ ID NO: 43280 - DNA, 71 bp, chicken (Gallus Gallus)
  misc_feature (36): n=c or t
ctcttttctagactgactgaagatcttgaagccccntgaaatctttcagccaaaatgcagtttctactcga

SEQ ID NO: 43281 - DNA, 71 bp, chicken (Gallus Gallus)
  misc_feature (36): n=a or g
gctgcatccatagatccatgacacagctgcaagtcncaagcacaggtgatgggaaaggcctgctgggaggt

SEQ ID NO: 43282 - DNA, 71 bp, chicken (Gallus Gallus)
  misc_feature (36): n=c or t
atgaagtcatagctaacagcaactgcagaaaaacanaggccaagcctcagtagtgcagcagtgttgtttct

SEQ ID NO: 43283 - DNA, 71 bp, chicken (Gallus Gallus)
  misc_feature (36): n=a or g
tgactcaatggcacctgaaggctgtctggatacacnaacaccaccaactttaatatcggcgtgatactgat

SEQ ID NO: 43284 - DNA, 71 bp, chicken (Gallus Gallus)
  misc_feature (36): n=a or g
gaattaggcgatgtgattgcccgcccaaaccatgcnagcagaaagcaaaaagctattttcaccaaacccca

SEQ ID NO: 43285 - DNA, 71 bp, chicken (Gallus Gallus)
  misc_feature (36): n=g or t
agagcttgctagtcacaccttggcattttgcttcanaataacagctatctgaccaggaacagacagcacca

SEQ ID NO: 43286 - DNA, 71 bp, chicken (Gallus Gallus)
  misc_feature (36): n=c or t
tgttctcactcagagcatgctgttaccatagagganctgcacattaagccagtgctattttgctgaatgcc

SEQ ID NO: 43287 - DNA, 71 bp, chicken (Gallus Gallus)
  misc_feature (36): n=c or t
cccctctgacactgcaaacagctcattcatgtttgnactttattactaaaagagaagcctaagtatgcatt

SEQ ID NO: 43288 - DNA, 71 bp, chicken (Gallus Gallus)
  misc_feature (36): n=a or g
ggctcggcatgatgaagccaagccctcctcaatctngttctggtgacagtcctgcacctcacgggtgggga

SEQ ID NO: 43289 - DNA, 71 bp, chicken (Gallus Gallus)
  misc_feature (36): n=c or t
acacgttgtccagcctacactatttgtgatactatnttgctagcccggagtagttcggctgctggtcagcg

SEQ ID NO: 43290 - DNA, 71 bp, chicken (Gallus Gallus)
  misc_feature (36): n=c or t
aaacaaccttatgctatcaggtcttaccagatctgngctgtggaacccgtacatgtcatacttggttgaag

SEQ ID NO: 43291 - DNA, 71 bp, chicken (Gallus Gallus)
  misc_feature (36): n=a or g
aagaccacactaaaagcagtaatgtttaaagtttcngagaactcttacctgtcattccatgactccgcatt

SEQ ID NO: 43292 - DNA, 71 bp, chicken (Gallus Gallus)
  misc_feature (36): n=a or g
gtggtcacggtgctgaaacaagcctttttaatgccnctgtctcacacaacattctcaaaagcaaactacac

SEQ ID NO: 43293 - DNA, 71 bp, chicken (Gallus Gallus)
  misc_feature (36): n=c or t
accactgttacttcttttccttgcacagaaacgtcnggtctgcgaaaatggcacagagccacaattcctgc

SEQ ID NO: 43294 - DNA, 71 bp, chicken (Gallus Gallus)
  misc_feature (36): n=c or t
gtagcccgatttggcttcgggggaacaagttcacangagacttgcccaagaaccctgcagaaggaaataaa

SEQ ID NO: 43295 - DNA, 71 bp, chicken (Gallus Gallus)
  misc_feature (36): n=a or c
gtttgatgtctgctctcccatcctgacctatatagngttgagaacactctgcaaatctgagattttttttt

SEQ ID NO: 43296 - DNA, 71 bp, chicken (Gallus Gallus)
  misc_feature (36): n=c or t
tgggactccttcagaggctggtgacaagaacagccntgatgacatgaaaacccaacttgaagttctcaaac

SEQ ID NO: 43297 - DNA, 71 bp, chicken (Gallus Gallus)
  misc_feature (36): n=a or g
tttttctactaaatagaaaattaactcaaagttgtntcagttaggttaggcctgctgctccataagggcag

SEQ ID NO: 43298 - DNA, 71 bp, chicken (Gallus Gallus)
  misc_feature (36): n=c or t
atcactgtccagtagcactttggctgaggtatgagntctcattttcttcagatagctgctgtgggtgttgt

SEQ ID NO: 43299 - DNA, 71 bp, chicken (Gallus Gallus)
  misc_feature (36): n=a or g
tggttatctgaaagtaaatcaggaatctctgttttnttttccagcatttctgtgttactacaaggtggcca

SEQ ID NO: 43300 - DNA, 71 bp, chicken (Gallus Gallus)
  misc_feature (36): n=a or g
atatttctaacgtgcgcactactgaattgagactcntattaaaaacagcaagaagtcgtttactgctgcta

SEQ ID NO: 43301 - DNA, 71 bp, chicken (Gallus Gallus)
  misc_feature (36): n=a or g
agaaaggcagatgggaggaagggatttggtgggatngtgatcgttgcatgcttagaggtaacaagaatgat

SEQ ID NO: 43302 - DNA, 71 bp, chicken (Gallus Gallus)
  misc_feature (36): n=a or g
atatgttgaaatagatcttttgacatgcatatagtngaaggaatgcataaacatctagtcataaatgagac

SEQ ID NO: 43303 - DNA, 71 bp, chicken (Gallus Gallus)
  misc_feature (36): n=a or g
caaatgaatcagattgttcatagaaacccaataacntgtgcatctagtaaatgcaggttttagataattta

SEQ ID NO: 43304 - DNA, 71 bp, chicken (Gallus Gallus)
  misc_feature (36): n=c or t
atagtgaccgaatgtcaatttgttaattttaacctngctggcaatttttaagaatcttagattgatgtctg

SEQ ID NO: 43305 - DNA, 71 bp, chicken (Gallus Gallus)
  misc_feature (36): n=a or c
ggaaagatttccagaacactagtgaaacatcttctntgagtgcatctgtaaagaaatctgaacttaaaaaa

SEQ ID NO: 43306 - DNA, 71 bp, chicken (Gallus Gallus)
  misc_feature (36): n=a or g
gggaagcttagaatctgcacaccgtgccttcttcangaaggaagagcatttcagaatcacgttcgtgaata

SEQ ID NO: 43307 - DNA, 71 bp, chicken (Gallus Gallus)
  misc_feature (36): n=a or g
cattcaaaagcacaatgagacttttctagacaagtnaaatacatatgcactgccgggtatcaacaaaaaga

SEQ ID NO: 43308 - DNA, 71 bp, chicken (Gallus Gallus)
  misc_feature (36): n=c or t
atgctatgagaaagtcttataaactcaggaccctangcagctcagtaattcctattaaacagaacttttcc

SEQ ID NO: 43309 - DNA, 71 bp, chicken (Gallus Gallus)
  misc_feature (36): n=c or t
aaaaagtgaaaaaacatgtattatatctccatcttngccaaattaccacaaggactttttttgtctcagaa

SEQ ID NO: 43310 - DNA, 71 bp, chicken (Gallus Gallus)
  misc_feature (36): n=c or t
gtcttattgtttctgtagatagatacaaatccctgntcatcataagaagaaaaactaagggcaagctcagt

SEQ ID NO: 43311 - DNA, 71 bp, chicken (Gallus Gallus)
  misc_feature (36): n=a or c
gagatgctagagcacgagctgttttcctgacctggnaagtaatgtgtttgcagatgaaaagaggaagatac

SEQ ID NO: 43312 - DNA, 71 bp, chicken (Gallus Gallus)
  misc_feature (36): n=c or t
ttcccaatttaaatatatgcagtgtcttccttctgntgccctgaaaatgtcctcccaaaggagatgatttc

SEQ ID NO: 43313 - DNA, 71 bp, chicken (Gallus Gallus)
  misc_feature (36): n=c or t
taaaaacatgcatgtacaaattgcaaacacaaacanatacatacaaagaaaagattacattaaactctaca

SEQ ID NO: 43314 - DNA, 71 bp, chicken (Gallus Gallus)
  misc_feature (36): n=a or g
aaaacactgaatctgtctctgcatctcctaccactnctgaaatcagaggtagaacaacttttgtatgatga

SEQ ID NO: 43315 - DNA, 71 bp, chicken (Gallus Gallus)
  misc_feature (36): n=c or t
aaaggctctttgttatagcattggatagctaaagtnagcacaatatcactgtattggtcattacctggaca

SEQ ID NO: 43316 - DNA, 71 bp, chicken (Gallus Gallus)
  misc_feature (36): n=a or g
ttggtagggactggaagaaatagataaaggcactcntggagcaattagaagtatatcagtgggtaaactgg

SEQ ID NO: 43317 - DNA, 71 bp, chicken (Gallus Gallus)
  misc_feature (36): n=a or g
ctccaggctccggtcctgacagttattaatttaganatgtttgcagtggatcagtccgagcaggagagctt

SEQ ID NO: 43318 - DNA, 71 bp, chicken (Gallus Gallus)
  misc_feature (36): n=c or t
tatgccctttatgttgtgctgagaaatctggaattnaatactaagcatttcagagtccataagatgcttgt

SEQ ID NO: 43319 - DNA, 71 bp, chicken (Gallus Gallus)
  misc_feature (36): n=c or t
acagctcaggctacgtgagtctgtgctggaaaacanataagctgcactagcagaagactctgataacatat

SEQ ID NO: 43320 - DNA, 71 bp, chicken (Gallus Gallus)
  misc_feature (36): n=a or c
tccccttgctccattttgagtgtgttaaatcccagnatactatgagagcaggtggaagtgagctggcagca

SEQ ID NO: 43321 - DNA, 71 bp, chicken (Gallus Gallus)
  misc_feature (36): n=g or t
cttgttctaaaggcatttacataggtgtggagattnatgtaagaatactgagccgtgcacttcgttttata

SEQ ID NO: 43322 - DNA, 71 bp, chicken (Gallus Gallus)
  misc_feature (36): n=a or g
atggtaagagggaacatccatcctgtcaggtggtgnctatgaaaatactgtcctacctgaaataacagtaa

SEQ ID NO: 43323 - DNA, 71 bp, chicken (Gallus Gallus)
  misc_feature (36): n=a or g
tcctcacatactttacagaaatgtccttgatgggtngcttctcagtttgaagtgaaattactgaaaacagt

SEQ ID NO: 43324 - DNA, 71 bp, chicken (Gallus Gallus)
  misc_feature (36): n=a or g
agatgatcaccaagagaaaacataatgattatttanataattggaaacctagaggaaaaaaaaactggtta

SEQ ID NO: 43325 - DNA, 71 bp, chicken (Gallus Gallus)
  misc_feature (36): n=a or g
atttttcagaaatttgcctacatacctaataaattnctttttcattaggcaagcaatagactttcagggtt

SEQ ID NO: 43326 - DNA, 71 bp, chicken (Gallus Gallus)
  misc_feature (36): n=c or t
aaccaattatctctgatacaggtactattaacctanttggatttaagtttgcattgggtttggtcacttac

SEQ ID NO: 43327 - DNA, 71 bp, chicken (Gallus Gallus)
  misc_feature (36): n=a or c
atagcagttcactgccatgccaagccaaaccttttnataattgatccatcctccttcatgatctccttctc

SEQ ID NO: 43328 - DNA, 71 bp, chicken (Gallus Gallus)
  misc_feature (36): n=c or t
agaatgctctcttatccatcagtttatgatcaatgnagaacttctatcacagtggcaaaatctcatcactg

SEQ ID NO: 43329 - DNA, 71 bp, chicken (Gallus Gallus)
  misc_feature (36): n=c or t
gggattctcagggggatttgagaatccctacaacanctgcctttttgtacaactcaaataatacactatga

SEQ ID NO: 43330 - DNA, 71 bp, chicken (Gallus Gallus)
  misc_feature (36): n=a or g
ataaaaagaatatccatccattaaccttgtttccancgtgggcttaatggaaagatacaaaattgtttagg

SEQ ID NO: 43331 - DNA, 71 bp, chicken (Gallus Gallus)
  misc_feature (36): n=a or c
ctgcacatagtcatcatccctcagaatccgagcatnaaggatttcttccttggttctcctaggtgtgaaga

SEQ ID NO: 43332 - DNA, 71 bp, chicken (Gallus Gallus)
  misc_feature (36): n=a or g
cctgtcttcctggtatttcacctgctgaagcagcancacggcccacgcttttcataaagatcttgagatgg

SEQ ID NO: 43333 - DNA, 71 bp, chicken (Gallus Gallus)
  misc_feature (36): n=c or t
gatgatttttcttgagaagaccacaaatcctacaancttgaatggagcagcctggcagacacctgacacat

SEQ ID NO: 43334 - DNA, 71 bp, chicken (Gallus Gallus)
  misc_feature (36): n=a or c
ccagaagcctttggcctgaatttagcgggatacgcnagtacgtgaatttctttccactgcctgactattgt

SEQ ID NO: 43335 - DNA, 71 bp, chicken (Gallus Gallus)
  misc_feature (36): n=c or t
aataaaattagatctattggttgctgacagaatttnatatgttccaggttggccatattacagttttcact

SEQ ID NO: 43336 - DNA, 71 bp, chicken (Gallus Gallus)
  misc_feature (36): n=a or g
gagatatcccattaacgatcctagtcttcaaggctnaaccctgtatttgtgtttcttagtggcttggattc

SEQ ID NO: 43337 - DNA, 71 bp, chicken (Gallus Gallus)
  misc_feature (36): n=a or g
ataataaaagacaaaagttgcctaactctttcccanggaaaatgttttatggtgaatcaaccatgcagctc

SEQ ID NO: 43338 - DNA, 71 bp, chicken (Gallus Gallus)
  misc_feature (36): n=a or g
ttcattaaggtctccaactgtggactgtctttaggncgttgataacttttgttagtgagaaggcagaagtt

SEQ ID NO: 43339 - DNA, 71 bp, chicken (Gallus Gallus)
  misc_feature (36): n=c or t
catgtaaagagcctcctgaaactggtttctcgaccntcaaaaagacatgctgcaaagtattcaatgtgcca

SEQ ID NO: 43340 - DNA, 71 bp, chicken (Gallus Gallus)
  misc_feature (36): n=a or g
aatagctaggtactcactttgccacttggttgaaanttgaagaaattgacatctgagaaaaaacaattcaa

SEQ ID NO: 43341 - DNA, 71 bp, chicken (Gallus Gallus)
  misc_feature (36): n=a or c
atccattccaaaatgttttccacttctatatacttntagtcatacttcaatcaaacagttatttacctccc

SEQ ID NO: 43342 - DNA, 71 bp, chicken (Gallus Gallus)
  misc_feature (36): n=c or t
tttgcacatcatttggagaacagtgtatggtacacncttagtggaatcactgtaggtataatagaacatac

SEQ ID NO: 43343 - DNA, 71 bp, chicken (Gallus Gallus)
  misc_feature (36): n=a or c
atcatcagatcttcctgttagaacaagttatttctnaactgagcctcccagatcctcatttatttttccag

SEQ ID NO: 43344 - DNA, 71 bp, chicken (Gallus Gallus)
  misc_feature (36): n=a or g
cactgcaacattgcacctatctgctttaatctcatnggagctggtggtggtgcagaacttcatttacattt

SEQ ID NO: 43345 - DNA, 71 bp, chicken (Gallus Gallus)
  misc_feature (36): n=c or t
tatccatttactctttttgcctttactcaaaacacngtcaaaactatggtccagaccctcccttttttttt

SEQ ID NO: 43346 - DNA, 71 bp, chicken (Gallus Gallus)
  misc_feature (36): n=g or t
taggttcaacccagagaaggataggcccagtgcagncatgctttcaaaaccttgggaatcacttgttttgt

SEQ ID NO: 43347 - DNA, 71 bp, chicken (Gallus Gallus)
  misc_feature (36): n=a or g
tcctttaggcttactgagaaacagaacttcagaccntgtgttaactgatggactgaacacgatcgtgagat

SEQ ID NO: 43348 - DNA, 71 bp, chicken (Gallus Gallus)
  misc_feature (36): n=c or t
ttgggttagagcaagtctgatctctgtggaaagagncaccatattcaattaactgaaaaagcaaaaccctt

SEQ ID NO: 43349 - DNA, 71 bp, chicken (Gallus Gallus)
  misc_feature (36): n=a or g
ggcaatataccataaactagctgagcagctgaaagntaaggaaattcaacagggaggagaaaataaaattt

SEQ ID NO: 43350 - DNA, 71 bp, chicken (Gallus Gallus)
  misc_feature (36): n=a or g
gtaatggaaaatgtttcctgttcttgatattcatgngaaacagataatcgccacaacccccatgaagtaca

SEQ ID NO: 43351 - DNA, 71 bp, chicken (Gallus Gallus)
  misc_feature (36): n=c or t
atttctgtgtaatctgtggtggggaaaagtcccttntgatgtctcaaaattatgatactgatggaatgcct

SEQ ID NO: 43352 - DNA, 71 bp, chicken (Gallus Gallus)
  misc_feature (36): n=a or g
cctgtgttaatgagtgaaatgtatttacagcaattncatttgaaagctagttcgctagttagcaaatgcga

SEQ ID NO: 43353 - DNA, 71 bp, chicken (Gallus Gallus)
  misc_feature (36): n=a or g
ctaactatatgtatttttactttgcctgcatatacntgcacatagataataatttgtatatccacacaaat

SEQ ID NO: 43354 - DNA, 71 bp, chicken (Gallus Gallus)
  misc_feature (36): n=a or g
cagcagtaagcacaaaaatgtggagaaagcataaantaagtttagtataaaaagtcagcatagaagtacag

SEQ ID NO: 43355 - DNA, 71 bp, chicken (Gallus Gallus)
  misc_feature (36): n=a or g
aaaagcgaaaaatttcctacactgtgttatccagcntgctcttttaaattatagtaataaacatcagagac

SEQ ID NO: 43356 - DNA, 71 bp, chicken (Gallus Gallus)
  misc_feature (36): n=a or g
ttgttagtgctgcccttcaacagtttgggtaaaagngactttccttttatcattcttgttgtcttctttag

SEQ ID NO: 43357 - DNA, 71 bp, chicken (Gallus Gallus)
  misc_feature (36): n=a or c
tttctttccaagataaagttaattttgctctttccncacatgtcttcattatgctggatgtaattatcagg

SEQ ID NO: 43358 - DNA, 71 bp, chicken (Gallus Gallus)
  misc_feature (36): n=c or t
aagtctatatttagtacagtcattcaggaaataaanatttctagtgaaataaaacgtggagatggtaatgg

SEQ ID NO: 43359 - DNA, 71 bp, chicken (Gallus Gallus)
  misc_feature (36): n=c or t
aaattggaaacaaccagtaaacaaaaagccagacangctggtattaaagaatgattgtttatagttcaata

SEQ ID NO: 43360 - DNA, 71 bp, chicken (Gallus Gallus)
  misc_feature (36): n=a or c
atccctcctcatccagcagtgacaggggtgctcaantgaagaacttggcagtcttccctagtaaaagttac

SEQ ID NO: 43361 - DNA, 71 bp, chicken (Gallus Gallus)
  misc_feature (36): n=c or t
ctagcttcactttcctagatcatctatcatgtcaangaaaggtgtaaggttcatgtgggactgccttttgt

SEQ ID NO: 43362 - DNA, 71 bp, chicken (Gallus Gallus)
  misc_feature (36): n=a or g
ttgacagtaatagtgattagtgtgagttgataattnacaacaaggagctacagccagagcagaaactgtct

SEQ ID NO: 43363 - DNA, 71 bp, chicken (Gallus Gallus)
  misc_feature (36): n=a or g
tgaaaaactaatttggacagttcagttacccatagnaaacagcaaattttccaaagtttatttaacggaaa

SEQ ID NO: 43364 - DNA, 71 bp, chicken (Gallus Gallus)
  misc_feature (36): n=a or g
ttattttctcatttagggagttagtgatgctgtttnctaaagatcttgcttttttacactgctctagaacc

SEQ ID NO: 43365 - DNA, 71 bp, chicken (Gallus Gallus)
  misc_feature (36): n=a or g
caaaataaattctgcctggagagcataaaagaaaanaagtggtcaaaatacaaccatcagggaagacattt

SEQ ID NO: 43366 - DNA, 71 bp, chicken (Gallus Gallus)
  misc_feature (36): n=a or g
aaaattaagtaatattagagatagttatagctatcnctactagtctaaagagggttgtaaacaatattgtt

SEQ ID NO: 43367 - DNA, 71 bp, chicken (Gallus Gallus)
  misc_feature (36): n=a or g
gaaaacacaacatatgcatccaactcatgaagaacntatctcagataaaatgtattagggccatagcaaat

SEQ ID NO: 43368 - DNA, 71 bp, chicken (Gallus Gallus)
  misc_feature (36): n=c or t
gttctgatatctctctcaaattaattcaacaccttntatttggatgttacaaattattgttatggaaaatt

SEQ ID NO: 43369 - DNA, 71 bp, chicken (Gallus Gallus)
  misc_feature (36): n=a or c
ggattagatgtgaataagtagtaatttaataaaaanacattttgaaggtaaacataattcttatatatatg

SEQ ID NO: 43370 - DNA, 71 bp, chicken (Gallus Gallus)
  misc_feature (36): n=c or t
ttatgaattcacaaggacgatacagccactcaagangctaagcagtattttctaccctccaactttgttta

SEQ ID NO: 43371 - DNA, 71 bp, chicken (Gallus Gallus)
  misc_feature (36): n=a or g
tgttcatacttacaggtacttcactgacaaattacnatctaatttgtatttgaccttctgtatttctgagt

SEQ ID NO: 43372 - DNA, 71 bp, chicken (Gallus Gallus)
  misc_feature (36): n=c or t
gtaatttgaaagaaatcagcttgcaacaatgttaancaatgtaccttctgaacagagcctgattgtacaca

SEQ ID NO: 43373 - DNA, 71 bp, chicken (Gallus Gallus)
  misc_feature (36): n=a or g
gcagcaaggtagctcgcagtagccttattagcaagntaaaaggagcagcgtgagcaagtcccaatcctgct

SEQ ID NO: 43374 - DNA, 71 bp, chicken (Gallus Gallus)
  misc_feature (36): n=c or t
cagccctgtgccctgctatcagaatgttccttggcnggccgagttcctttattccttttttataggaatgg

SEQ ID NO: 43375 - DNA, 71 bp, chicken (Gallus Gallus)
  misc_feature (36): n=a or g
ccttaggaatcagaagtatatagtctaaaatgctgnaaggagatacctcaggaggcatttaacagaacagg

SEQ ID NO: 43376 - DNA, 71 bp, chicken (Gallus Gallus)
  misc_feature (36): n=c or t
aatacagcggtaactgtataaactccctgacagganagctatgcttactaatggtttttaataagatagac

SEQ ID NO: 43377 - DNA, 71 bp, chicken (Gallus Gallus)
  misc_feature (36): n=a or g
cttttctaattgtcacgtagtagaaattcttcctcngtggcatcctctccatagtatctagtacagggaac

SEQ ID NO: 43378 - DNA, 71 bp, chicken (Gallus Gallus)
  misc_feature (36): n=a or c
tataagttacatgtttgtgcatgtcagaattgttgncagtttagcgtgtttgggtaagggggtaggtgaaa

SEQ ID NO: 43379 - DNA, 71 bp, chicken (Gallus Gallus)
  misc_feature (36): n=a or g
tctttgagcttttatcatctgtaacaggatcccccngatgagccaacagcacacttgatctattatggcaa

SEQ ID NO: 43380 - DNA, 71 bp, chicken (Gallus Gallus)
  misc_feature (36): n=a or g
aaatgtgctagaggtgcagagaacaattcctattgnctccgacaagtgatttcagtgcatttcaaattgta

SEQ ID NO: 43381 - DNA, 71 bp, chicken (Gallus Gallus)
  misc_feature (36): n=g or t
aaatatatttgccgttttaacaaattctaggcttanaatacctagagaggtctactttgggccaattccaa

SEQ ID NO: 43382 - DNA, 71 bp, chicken (Gallus Gallus)
  misc_feature (36): n=a or g
tccagtttgtaggaactgtaagtagatatttcagcnttttcttaccttgaagtccttcttacagcaacatt

SEQ ID NO: 43383 - DNA, 71 bp, chicken (Gallus Gallus)
  misc_feature (36): n=c or t
ttatgtattttgttaatttccaagacacatttatantcatgtgtatttcatgcttgcccattaggtgacaa

SEQ ID NO: 43384 - DNA, 71 bp, chicken (Gallus Gallus)
  misc_feature (36): n=a or g
acatctgatacttgaagattcaagaatagctcctcntggtcagaaacattggcataaaaagctaacatgaa

SEQ ID NO: 43385 - DNA, 71 bp, chicken (Gallus Gallus)
  misc_feature (36): n=g or t
agtctctttggtaatacagcctactcctgaagacancataacctgtatttgaaaaacacagtaactattga

SEQ ID NO: 43386 - DNA, 71 bp, chicken (Gallus Gallus)
  misc_feature (36): n=c or t
tagtatgttttgtgagatgagggttttttgtcatcngcacagcagtaactagcaaatagttttgcttgtca

SEQ ID NO: 43387 - DNA, 71 bp, chicken (Gallus Gallus)
  misc_feature (36): n=a or g
agtactgtggatttgctgcatctccaatgaacgaangaatagaaggaaaagtctctctgtccctttccctt

SEQ ID NO: 43388 - DNA, 71 bp, chicken (Gallus Gallus)
  misc_feature (36): n=c or t
tagagattctatgcaaaatttaggttttactttccnttagaatgtttttgtataaactttgtatgcaattt

SEQ ID NO: 43389 - DNA, 71 bp, chicken (Gallus Gallus)
  misc_feature (36): n=c or t
cataaccagtgagaaagcttcataagtaaataattngcagtttactgcttgacaccacagagttgttgaaa

SEQ ID NO: 43390 - DNA, 71 bp, chicken (Gallus Gallus)
  misc_feature (36): n=c or t
ttaccaccaaggacccccagcaggcttaagattccnttagtagttatatgtgtgcatagtgaatgtcttgc

SEQ ID NO: 43391 - DNA, 71 bp, chicken (Gallus Gallus)
  misc_feature (36): n=a or g
agacccattgaaaaccaagtgaaacagtacagtttncatttggctagagctcccatgcacagctccttacc

SEQ ID NO: 43392 - DNA, 71 bp, chicken (Gallus Gallus)
  misc_feature (36): n=a or g
ttttatctgtggctgtcattttttcaaggtacttantggagctatgtctccctattgcagagggtggattt

SEQ ID NO: 43393 - DNA, 71 bp, chicken (Gallus Gallus)
  misc_feature (36): n=c or t
ttccaaccctatttatggtgaaaacgttttgtcgtngtttgagaaataatgtgaactttttttgcttgttt

SEQ ID NO: 43394 - DNA, 71 bp, chicken (Gallus Gallus)
  misc_feature (36): n=g or t
attcaaatcaggtctatatctaatggtacggtcatntcctattgcatagtttatagaaatttgaaccaaaa

SEQ ID NO: 43395 - DNA, 71 bp, chicken (Gallus Gallus)
  misc_feature (36): n=c or t
caaataaaaagagttaaaagcagggagtacttatangtagggagaattcctcttgtttcagaaagcttagt

SEQ ID NO: 43396 - DNA, 71 bp, chicken (Gallus Gallus)
  misc_feature (36): n=a or g
tgtaaatacagatatctgattaagacaacagactcntataagcacagtatagctacctctgattttatgta

SEQ ID NO: 43397 - DNA, 71 bp, chicken (Gallus Gallus)
  misc_feature (36): n=g or t
tgatggcataagctacaggtgaggtgacataaattnccatgcttaagcttcttgctaaggagttgttaaca

SEQ ID NO: 43398 - DNA, 71 bp, chicken (Gallus Gallus)
  misc_feature (36): n=c or t
tgaccagggcataaagtaattaaacccagtatcagnatgcttaatggagaacagcatagcgattagcatgc

SEQ ID NO: 43399 - DNA, 71 bp, chicken (Gallus Gallus)
  misc_feature (36): n=a or g
ctggagtaatagagctcacttaccccgctagctgtntttatttagcatacttgtgccaagtatagagttga

SEQ ID NO: 43400 - DNA, 71 bp, chicken (Gallus Gallus)
  misc_feature (36): n=a or c
aatgagcttttctgattcacattggtattgcaccanctgtggtgatgaaagttgtttgctggaaatgcaga

SEQ ID NO: 43401 - DNA, 71 bp, chicken (Gallus Gallus)
  misc_feature (36): n=c or t
acatacatgctggtagccataaacaacaccttcaantttgactgcacatcaacatttttaattcccctgaa

SEQ ID NO: 43402 - DNA, 71 bp, chicken (Gallus Gallus)
  misc_feature (36): n=g or t
tactagaaagccagaaaatgagcaagaaatcttctncagtgttaattctagcaccgatacaataatagtaa

SEQ ID NO: 43403 - DNA, 71 bp, chicken (Gallus Gallus)
  misc_feature (36): n=c or t
gatagaaacagcattgtacaccatctgtgcatagcnacccaaagcttttgtcagaagagaactatagtcta

SEQ ID NO: 43404 - DNA, 71 bp, chicken (Gallus Gallus)
  misc_feature (36): n=a or c
agtgcttatgtgttagatagaaactcagatggctcntaacagtaagccagcataactggatttcacaaaca

SEQ ID NO: 43405 - DNA, 71 bp, chicken (Gallus Gallus)
  misc_feature (36): n=g or t
aaaatgttggagtccagaagatgttaatatatcatngtgctaaaagatggttataaataggcaacaaaatt

SEQ ID NO: 43406 - DNA, 71 bp, chicken (Gallus Gallus)
  misc_feature (36): n=c or t
ctggattcactttgcacctgtaaccagctagtcatnacttggaagagtcttgttttttgaaaattagacaa

SEQ ID NO: 43407 - DNA, 71 bp, chicken (Gallus Gallus)
  misc_feature (36): n=c or t
tgaaatttgttcatgttttgctggaagaagcacacntatgtttgtgaagtgctcttcaaatgaaccatctg

SEQ ID NO: 43408 - DNA, 71 bp, chicken (Gallus Gallus)
  misc_feature (36): n=c or t
aattctgagaagtatcccttatgttaaaattcaaancacctacttttgctgcttggccctgatttgatcag

SEQ ID NO: 43409 - DNA, 71 bp, chicken (Gallus Gallus)
  misc_feature (36): n=a or g
ataacaccaactgtctggatagtcagctaagaccantgatatacctgcattttagtctgctacttgctctt

SEQ ID NO: 43410 - DNA, 71 bp, chicken (Gallus Gallus)
  misc_feature (36): n=a or g
catttcattccaggctgagatttttcaccggggtcngagtcaatatactgccagatctgtggcttgcttgc

SEQ ID NO: 43411 - DNA, 71 bp, chicken (Gallus Gallus)
  misc_feature (36): n=a or g
atgagtggaataacagtgactgctgatgctaagganaagatgatccctaagataatggccacacatccctt

SEQ ID NO: 43412 - DNA, 71 bp, chicken (Gallus Gallus)
  misc_feature (36): n=c or t
agaatgaaaaaggccatttgacccactgagtttcancctttccttgtacattattttcccaagacacatgc

SEQ ID NO: 43413 - DNA, 71 bp, chicken (Gallus Gallus)
  misc_feature (36): n=a or g
aatcatcctcaaaaagatgtgcagaactacagtatntttcatctggagttacatatagagggacaaacttg

SEQ ID NO: 43414 - DNA, 71 bp, chicken (Gallus Gallus)
  misc_feature (36): n=g or t
tgcagcactagttccattcacctaaactgaataggntggcaatgtaacaaaatgacttcatatacactgag

SEQ ID NO: 43415 - DNA, 71 bp, chicken (Gallus Gallus)
  misc_feature (36): n=c or t
ggtaccctaacaaatatctagatttggtccctatanaggcagtgctatgaaaagattacatcaaccagtgt

SEQ ID NO: 43416 - DNA, 71 bp, chicken (Gallus Gallus)
  misc_feature (36): n=g or t
tgcaaaaatgctcattcctaaaaaatacagtaattnttaatgtaatttctagccatcactaatttctttta

SEQ ID NO: 43417 - DNA, 71 bp, chicken (Gallus Gallus)
  misc_feature (36): n=c or t
gggtcaggtaatgttgtataaaaattactttctgcnagtaaaaacagaaccgtaggaggtaattatctgac

SEQ ID NO: 43418 - DNA, 71 bp, chicken (Gallus Gallus)
  misc_feature (36): n=c or t
tagacacctcatacagtgatgaaacttgagtcacantgtgtcatctgcaaaaaggacaatggcagcactga

SEQ ID NO: 43419 - DNA, 71 bp, chicken (Gallus Gallus)
  misc_feature (36): n=a or g
acagcaagacaaagctggccatgccctacaggaaanccaggggatggactttactctgtggcatgccaagt

SEQ ID NO: 43420 - DNA, 71 bp, chicken (Gallus Gallus)
  misc_feature (36): n=c or t
atgggatggatgtcattgataaaaacaagtctggtngtgtagaggtcattccatagtatccacataagtta

SEQ ID NO: 43421 - DNA, 71 bp, chicken (Gallus Gallus)
  misc_feature (36): n=c or t
gccaaagaaaaagccagtcttgtaagtccagatctncaaaagtaaagcagacgggcagaacttttatgctt

SEQ ID NO: 43422 - DNA, 71 bp, chicken (Gallus Gallus)
  misc_feature (36): n=a or c
agcaagaaggcaaatactccagggctccaagttagnaatgaaatgagtcccatatgtagtgagagcactca

SEQ ID NO: 43423 - DNA, 71 bp, chicken (Gallus Gallus)
  misc_feature (36): n=g or t
ccttcaacaaagagtaagtccataagccccagaacntagaaagcagcagtgagacatgcttggatcaggac

SEQ ID NO: 43424 - DNA, 71 bp, chicken (Gallus Gallus)
  misc_feature (36): n=a or c
gtcagccctaaggaaattcggtactggtgctactgnatacactttaaataggtagtgtgcatataatgaaa

SEQ ID NO: 43425 - DNA, 71 bp, chicken (Gallus Gallus)
  misc_feature (36): n=c or t
taaatccaagcctgaaatgatggaaagtgcgacatngtgtgcctgggtgtgtgtgcgcgcgtaggggtgtg

SEQ ID NO: 43426 - DNA, 71 bp, chicken (Gallus Gallus)
  misc_feature (36): n=c or t
tcataacatgaagttgtttttctggtattcttcaanctgaatgtaccttggctggtttacaggggcttgtt

SEQ ID NO: 43427 - DNA, 71 bp, chicken (Gallus Gallus)
  misc_feature (36): n=c or t
aggacacaatacactgaaacacagataccctgattncttatgtcttttaagcaattaaatccctaagtaca

SEQ ID NO: 43428 - DNA, 71 bp, chicken (Gallus Gallus)
  misc_feature (36): n=a or c
agtgaaagacaccgcaggtctgcagggtaatcatanatggagtacagatggcagatgaatctcatggtcag

SEQ ID NO: 43429 - DNA, 71 bp, chicken (Gallus Gallus)
  misc_feature (36): n=c or t
tctgtatccaacatggggaactgaggccagctgtcnaatctttccatcatcgctaccatcattcacattct

SEQ ID NO: 43430 - DNA, 71 bp, chicken (Gallus Gallus)
  misc_feature (36): n=c or t
tctgtaaaggagtaaaacaattaggaatgagacttntgtggtcaaatatccctccacagagagtagattgt

SEQ ID NO: 43431 - DNA, 71 bp, chicken (Gallus Gallus)
  misc_feature (36): n=c or t
taacttatgaggatatgaagacatcactggacgttntggggcttatcatctattctggcatggcaaggagt

SEQ ID NO: 43432 - DNA, 71 bp, chicken (Gallus Gallus)
  misc_feature (36): n=a or g
attctattctctaagtaaatgtcatgttcacagtgntcttctatctgatagtgaatactcatgatgttaca

SEQ ID NO: 43433 - DNA, 71 bp, chicken (Gallus Gallus)
  misc_feature (36): n=a or g
tcttgaaaatgtgttcacatagggcaaactggaagnaaacatatgacgttatatgagcagacagacatgat

SEQ ID NO: 43434 - DNA, 71 bp, chicken (Gallus Gallus)
  misc_feature (36): n=a or c
ttctcttggtaagctgcaaagtgaaaacagcatccntgtataatacagaactgcagagtatcatacaaaaa

SEQ ID NO: 43435 - DNA, 71 bp, chicken (Gallus Gallus)
  misc_feature (36): n=a or g
aatttatattattttcaaatgtaactgaacatgagnaatactcactaattttggggataattcatgaagag

SEQ ID NO: 43436 - DNA, 71 bp, chicken (Gallus Gallus)
  misc_feature (36): n=c or t
agatcaggcagatggataccttctgatctgcaagangttgctgtaactgtgtattcttaaatgtgtgttta

SEQ ID NO: 43437 - DNA, 71 bp, chicken (Gallus Gallus)
  misc_feature (36): n=a or g
aaaattatcctgattgcctcagttttggaggaagtngtctattttgttgagtgctacaaacctgactgcga

SEQ ID NO: 43438 - DNA, 71 bp, chicken (Gallus Gallus)
  misc_feature (36): n=a or g
catgtactcaggaaaagtaacctgggaattacctgngatcaaatgaaagattctggtaagacataataact

SEQ ID NO: 43439 - DNA, 71 bp, chicken (Gallus Gallus)
  misc_feature (36): n=a or g
cattattctacgttggagtcagtaagtctcataccnttcatttttgaatctgcgttattattatacctgca

SEQ ID NO: 43440 - DNA, 71 bp, chicken (Gallus Gallus)
  misc_feature (36): n=g or t
ctaaaagtgcagaagatagaactgaaagcaattttnatttgtaaaaagtggacacagttcaacagtggcaa

SEQ ID NO: 43441 - DNA, 71 bp, chicken (Gallus Gallus)
  misc_feature (36): n=c or t
acttttattttgacccaaaagcccgaggcaaactanagcagagggatggaggagaggataatttaactcat

SEQ ID NO: 43442 - DNA, 71 bp, chicken (Gallus Gallus)
  misc_feature (36): n=a or g
ggtatttgtatactcctcccttcagcacagattagnaattgttatttctgctgaatgaactttgatgataa

SEQ ID NO: 43443 - DNA, 71 bp, chicken (Gallus Gallus)
  misc_feature (36): n=c or t
tatatttaccttgcccatctgatggacagatgcacnggtgctttattgctcggcaactcttgtgaccagac

SEQ ID NO: 43444 - DNA, 71 bp, chicken (Gallus Gallus)
  misc_feature (36): n=a or g
cctgtaagcagctacttcacacaaacattcaatctncccatatatcaaaatatatatgttcttagctgaag

SEQ ID NO: 43445 - DNA, 71 bp, chicken (Gallus Gallus)
  misc_feature (36): n=a or g
caagccagaattttctttgcttagtctcaaccaaanctgatagaattcctaatctgactaatttttcttta

SEQ ID NO: 43446 - DNA, 71 bp, chicken (Gallus Gallus)
  misc_feature (36): n=a or c
ttatagtatcacaagtcatgtgtgagagtgtgttcnagtgcaaaagctgatgatatctgcattagctgaga

SEQ ID NO: 43447 - DNA, 71 bp, chicken (Gallus Gallus)
  misc_feature (36): n=a or g
aattcagatgaaagaagctcccagcatacccctgantcccaggacttgtctagtctgttagcagatttctt

SEQ ID NO: 43448 - DNA, 71 bp, chicken (Gallus Gallus)
  misc_feature (36): n=g or t
gatgagttatttccaaagtatagggatctagatcangcaggatactatcacaatggactaaccatcccctt

SEQ ID NO: 43449 - DNA, 71 bp, chicken (Gallus Gallus)
  misc_feature (36): n=a or g
agggcaacaactcctgagtggggatgggaggagaanagacatgcctcagcaaaaggtattttcattgcgtt

SEQ ID NO: 43450 - DNA, 71 bp, chicken (Gallus Gallus)
  misc_feature (36): n=c or t
attatttatctcatcctacagcaggaaaaaaagacntcgcatgtgttatttttaatcaagtgttggtggag

SEQ ID NO: 43451 - DNA, 71 bp, chicken (Gallus Gallus)
  misc_feature (36): n=c or t
ctttcttctcatattcaaatctgaaagttatcttanttttaaccattcagtgactttgatcaaatgctgtg

SEQ ID NO: 43452 - DNA, 71 bp, chicken (Gallus Gallus)
  misc_feature (36): n=a or g
ttcactttctgaagcaggacacgctggctgcattgngtttgtatgtatctgaattaagctgtggggttagg

SEQ ID NO: 43453 - DNA, 71 bp, chicken (Gallus Gallus)
  misc_feature (36): n=a or g
tagcaataacaagagtcacctgagaaatgacaaaantaggactgcattcatttttcaggtcagtctctatg

SEQ ID NO: 43454 - DNA, 71 bp, chicken (Gallus Gallus)
  misc_feature (36): n=c or t
aatcatggattcaaattcatttctgcttagccctgngatttctcttatgtatacctgcacagcaagtaccg

SEQ ID NO: 43455 - DNA, 71 bp, chicken (Gallus Gallus)
  misc_feature (36): n=a or c
tcttttccttaggtggatgagaagctcaaatgatanaatttcccagtaatgcaaatttttattcaccgtag

SEQ ID NO: 43456 - DNA, 71 bp, chicken (Gallus Gallus)
  misc_feature (36): n=c or t
ttagaccattaacaaaaacaggaacgggaatccatnatatggtctttggagagcactttgcatctgctgtt

SEQ ID NO: 43457 - DNA, 71 bp, chicken (Gallus Gallus)
  misc_feature (36): n=c or t
tgtaggaaagattgtcataacagttaccttacatangtgtgttaagggaaatatctgtggtttgcttttaa

SEQ ID NO: 43458 - DNA, 71 bp, chicken (Gallus Gallus)
  misc_feature (36): n=c or t
aattaatacagcaataaaatctcatctctttgtgtntcagcagtcctaagttgttttcagctcctctggtg

SEQ ID NO: 43459 - DNA, 71 bp, chicken (Gallus Gallus)
  misc_feature (36): n=a or g
caatctatacagtttaaagactgcccttgattttcnttaagttggatcacaaaattggaacgaaagaaatt

SEQ ID NO: 43460 - DNA, 71 bp, chicken (Gallus Gallus)
  misc_feature (36): n=c or t
tttcatatggagtagcacagcaatttgtgtagctgngatgtgagtttgcaaagaaaggcccttgagctgca

SEQ ID NO: 43461 - DNA, 71 bp, chicken (Gallus Gallus)
  misc_feature (36): n=a or g
ttgcacaaagaaatgggttacatcctaaactgcagngatagaatgagcaatcatgcaggctcccagactaa

SEQ ID NO: 43462 - DNA, 71 bp, chicken (Gallus Gallus)
  misc_feature (36): n=a or g
tttatttccatcactgccataggatactcagaagantgacccctgctgtgcagtgtcgctaagcagtgttt

SEQ ID NO: 43463 - DNA, 71 bp, chicken (Gallus Gallus)
  misc_feature (36): n=a or g
tattggagccgctctatctatcacagtgaagaaaantctcaactcattaaatcaaaatctgtttagcaggt

SEQ ID NO: 43464 - DNA, 71 bp, chicken (Gallus Gallus)
  misc_feature (36): n=a or g
taaaagtgtgcagatgagagtgtcctttatgatggntcagagatattctggccactaagattttcagacct

SEQ ID NO: 43465 - DNA, 71 bp, chicken (Gallus Gallus)
  misc_feature (36): n=g or t
cacactgtcatactgcatgagcaatgagccaagtgnaaacatgttaacatacgcatacatccttccttctt

SEQ ID NO: 43466 - DNA, 71 bp, chicken (Gallus Gallus)
  misc_feature (36): n=g or t
gaagctctgcaaaggctgtcctaaggagcctgcaanatggtccatagaggtcttgaagagcatagttctgg

SEQ ID NO: 43467 - DNA, 71 bp, chicken (Gallus Gallus)
  misc_feature (36): n=c or t
gatttcccttcactggtctcacccaggaggtatgcnctgaatatataaagcatttttctaggcaggctgcc

SEQ ID NO: 43468 - DNA, 71 bp, chicken (Gallus Gallus)
  misc_feature (36): n=a or g
gctcataccttgaaaagtctttaggagggtggtagngaaatggagatgcctcctctgtcttcaggagggag

SEQ ID NO: 43469 - DNA, 71 bp, chicken (Gallus Gallus)
  misc_feature (36): n=c or t
gacttgtattgttttacttctgcagagggtgcaacncacagtgagcacagagcacttatgtccgagctgaa

SEQ ID NO: 43470 - DNA, 71 bp, chicken (Gallus Gallus)
  misc_feature (36): n=c or t
aaacctgggctgcaaatggttcttcccattgttggngttagcttatgcagctcagtgagcagcatgtgtat

SEQ ID NO: 43471 - DNA, 71 bp, chicken (Gallus Gallus)
  misc_feature (36): n=c or t
ggtacaataatgctttgaaggacaaatataataccnattaaatactgtcctaatgtgcctttctgtgtaag

SEQ ID NO: 43472 - DNA, 71 bp, chicken (Gallus Gallus)
  misc_feature (36): n=c or t
tatactgttcgtatagccttcagtctataaatgaangaccagatgtttgacaggacctgttaatgcttcct

SEQ ID NO: 43473 - DNA, 71 bp, chicken (Gallus Gallus)
  misc_feature (36): n=a or g
ccatctgacagactcagtgccatctgcagaccaccnaattctcttgaatactccacatttccagtgtggga

SEQ ID NO: 43474 - DNA, 71 bp, chicken (Gallus Gallus)
  misc_feature (36): n=a or g
agtaaaattacacaaatagctaaattgcaacgcatngtagagtaaattatcagtttattcataatctcaac

SEQ ID NO: 43475 - DNA, 71 bp, chicken (Gallus Gallus)
  misc_feature (36): n=a or g
tctgtgcctctgcaaaccttaggaaaactttcccangcacacatgaattgcctgctttgtttgacctgttt

SEQ ID NO: 43476 - DNA, 71 bp, chicken (Gallus Gallus)
  misc_feature (36): n=c or t
aggagagggggagatgcacctcaccgtaggatctgnaaggcattgtaatttagaggcagttacagagcaga

SEQ ID NO: 43477 - DNA, 71 bp, chicken (Gallus Gallus)
  misc_feature (36): n=a or g
ggtccagtgatgtcttttattggatcatttagtgcngctggaaagtgcggtccagctttagataccaaatc

SEQ ID NO: 43478 - DNA, 71 bp, chicken (Gallus Gallus)
  misc_feature (36): n=a or g
ttatccctactgtcctagagcacaatagggagtacnttagtctgccatgtaaatctggggctggctatgct

SEQ ID NO: 43479 - DNA, 71 bp, chicken (Gallus Gallus)
  misc_feature (36): n=a or g
ttctttgtttagaagaacacctcatgaccaatcatnataaaatgataaaatgaatcagatatgccataaag

SEQ ID NO: 43480 - DNA, 71 bp, chicken (Gallus Gallus)
  misc_feature (36): n=a or g
ttcacatctgagacagcacgagatgggtttggtcantgtatgggttctaaatatctctaagcagttttgaa

SEQ ID NO: 43481 - DNA, 71 bp, chicken (Gallus Gallus)
  misc_feature (36): n=c or t
tttatgaagcaccaagaaatattgggaaatgcaaangaaggaaaatagcaaacgcctttggcatggataat

SEQ ID NO: 43482 - DNA, 71 bp, chicken (Gallus Gallus)
  misc_feature (36): n=a or g
ttctgaagaagttctaaacttagaagaaaaaacacnaagtagaatgactttactcatattagaaaatcgtt

SEQ ID NO: 43483 - DNA, 71 bp, chicken (Gallus Gallus)
  misc_feature (36): n=c or t
aatcatacacacaaactgagatttgattctttctgnctcttggctgtgatattatttttccccattcattt

SEQ ID NO: 43484 - DNA, 71 bp, chicken (Gallus Gallus)
  misc_feature (36): n=a or g
taccatctattgttgatgttattcattgaacctccncaggctcaggaagttgtcttgatttatgctttcaa

SEQ ID NO: 43485 - DNA, 71 bp, chicken (Gallus Gallus)
  misc_feature (36): n=a or g
attacacagatattttctagtatgtagagcagaaantctacactcttctgcataatgtagttgataatttc

SEQ ID NO: 43486 - DNA, 71 bp, chicken (Gallus Gallus)
  misc_feature (36): n=c or t
attttgttgcaacaaactgcctgacactgttcgtgntctgggtcaggttttctaaggcacctcagagtaaa

SEQ ID NO: 43487 - DNA, 71 bp, chicken (Gallus Gallus)
  misc_feature (36): n=c or t
cactcaagaaataccaggagtcaaactgcagtgtgntcttaattcatctccattgagagtgtgcttaaatg

SEQ ID NO: 43488 - DNA, 71 bp, chicken (Gallus Gallus)
  misc_feature (36): n=g or t
attccttaaactgccactataaagtgctccattcancacttgtacaaactatattctaagggaaaagtatc

SEQ ID NO: 43489 - DNA, 71 bp, chicken (Gallus Gallus)
  misc_feature (36): n=c or t
aacagaatgagtaggtaggttaatgtgttttgtagnggaacagtaggaaatggctacctcttactatgaat

SEQ ID NO: 43490 - DNA, 71 bp, chicken (Gallus Gallus)
  misc_feature (36): n=c or t
tacagcgtatgttctatctggatttttaccagtaanaattcacaatgcacaaagactttaagggagtgcat

SEQ ID NO: 43491 - DNA, 71 bp, chicken (Gallus Gallus)
  misc_feature (36): n=c or t
atgtaatatatgcatcaacaccaatactacaatatnaatttttgctcaaaaagcagtccaagtactacatc

SEQ ID NO: 43492 - DNA, 71 bp, chicken (Gallus Gallus)
  misc_feature (36): n=a or c
actacgttgcttttgttaattgggccatgactacanctgggaaatagctgtttcagttgacatcagtccta

SEQ ID NO: 43493 - DNA, 71 bp, chicken (Gallus Gallus)
  misc_feature (36): n=c or t
ctaaaaccaacattaagctttttgctgaaacaacangaacattagcctttaaaaatagcacactaagcctt

SEQ ID NO: 43494 - DNA, 71 bp, chicken (Gallus Gallus)
  misc_feature (36): n=a or c
tgaatctacctgtcatgatcagcatgcagatagatngaatttgctttatggtaagattaatttattttatg

SEQ ID NO: 43495 - DNA, 71 bp, chicken (Gallus Gallus)
  misc_feature (36): n=a or c
gaatatgttcggtcttccgtaggtttgcatccctanttctagctgtttgtgttggaatctgtggtgtggct

SEQ ID NO: 43496 - DNA, 71 bp, chicken (Gallus Gallus)
  misc_feature (36): n=c or t
ttgtaatgactccctagaaaagaagcagctgaggancaggtggactgaatgtgcactctctgagcagcact

SEQ ID NO: 43497 - DNA, 71 bp, chicken (Gallus Gallus)
  misc_feature (36): n=a or g
tacgtgggacctgagctgataacttgcagctacccntgatgtgatgcctctcagcagcagatccttcttgt

SEQ ID NO: 43498 - DNA, 71 bp, chicken (Gallus Gallus)
  misc_feature (36): n=a or g
attttagatgtaaatcttcagtgtagaagatctacnctgtcccagttgtagaaagaagtcttaccacagat

SEQ ID NO: 43499 - DNA, 71 bp, chicken (Gallus Gallus)
  misc_feature (36): n=a or c
agcaaactttttcctcaacctctgtccttgcgcacnaccatacacaatcagctctgtagtcagcactgtca

SEQ ID NO: 43500 - DNA, 71 bp, chicken (Gallus Gallus)
  misc_feature (36): n=c or t
cactcccagaaagatggtcttcagtgcatgcactantgccaagcagtaagataaatggcaactttgaattc

SEQ ID NO: 43501 - DNA, 71 bp, chicken (Gallus Gallus)
  misc_feature (36): n=a or g
atgataaatagagctaagggttgtttattacaaacncttgctatcttgaatgtgttgccatctcattacaa

SEQ ID NO: 43502 - DNA, 71 bp, chicken (Gallus Gallus)
  misc_feature (36): n=c or t
aattaaccatgaatgggatgtagattttctaagtgnctgatgtaattatttgagttaataaacaacttgta

SEQ ID NO: 43503 - DNA, 71 bp, chicken (Gallus Gallus)
  misc_feature (36): n=c or t
ctttctcaattcagatttacctaaccctttcagaangctttatggtgctgggcaatgatgcacattctgca

SEQ ID NO: 43504 - DNA, 71 bp, chicken (Gallus Gallus)
  misc_feature (36): n=c or t
atttaacaccatttttctggaaactgttctggaccntgcaggtagattgggaaaaatatccaatgcgagac

SEQ ID NO: 43505 - DNA, 71 bp, chicken (Gallus Gallus)
  misc_feature (36): n=g or t
accaatcgctacaccttcttttgagcagctaaattnagtgatgcttttgctgtttaatattaaagtttaga

SEQ ID NO: 43506 - DNA, 71 bp, chicken (Gallus Gallus)
  misc_feature (36): n=g or t
tacttcaaaactgccgttggcaaaaatgtaactgangaagaggtaagggcacatcactggttgggtttgac

SEQ ID NO: 43507 - DNA, 71 bp, chicken (Gallus Gallus)
  misc_feature (36): n=c or t
atctctgctgttttcaggccattagctcggacacangcaaaggacctctaatgggattgcttaactctggc

SEQ ID NO: 43508 - DNA, 71 bp, chicken (Gallus Gallus)
  misc_feature (36): n=g or t
tgtggtatgaatgtggctgcattcataaaccttgcngaaagtgtggagtgtgagagtctcagaacacagga

SEQ ID NO: 43509 - DNA, 71 bp, chicken (Gallus Gallus)
  misc_feature (36): n=c or t
agctgactagattacacagatcctagattaccactnggggtttatctgcttatcttggcagatcaacttcc

SEQ ID NO: 43510 - DNA, 71 bp, chicken (Gallus Gallus)
  misc_feature (36): n=a or g
aaatcttttccttacaggttaaagtgtggatacttnctggatcaatgttgttactgatgatgtgtaggcac

SEQ ID NO: 43511 - DNA, 71 bp, chicken (Gallus Gallus)
  misc_feature (36): n=a or g
tgcttattatcagagagtgagtgagcaatgaacacntaagggtatgatcatttttgcagaactagatatct

SEQ ID NO: 43512 - DNA, 71 bp, chicken (Gallus Gallus)
  misc_feature (36): n=c or t
atttgttggattcattttcaaaggcgatatttacantgcaacacaacacagataggatgtgatttagacag

SEQ ID NO: 43513 - DNA, 71 bp, chicken (Gallus Gallus)
  misc_feature (36): n=g or t
ctgaacattttatagaaataaaagggcattttaatnttcttattaaatgctgagagataaatagccatgag

SEQ ID NO: 43514 - DNA, 71 bp, chicken (Gallus Gallus)
  misc_feature (36): n=g or t
caggatgttgtctttaaagctcatgttatgaatttncagtgaattttaagtgggatttgtttgttttccaa

SEQ ID NO: 43515 - DNA, 71 bp, chicken (Gallus Gallus)
  misc_feature (36): n=c or t
acatgttttaaatagttgcatttctctgtttgcagntatggtattttcccagaaattttctgtgatgaata

SEQ ID NO: 43516 - DNA, 71 bp, chicken (Gallus Gallus)
  misc_feature (36): n=c or t
aaatgcaaatttattaaagcttccaacaaaaatgtntttaatctaggaaacaacatcctcagcaaaaaaat

SEQ ID NO: 43517 - DNA, 71 bp, chicken (Gallus Gallus)
  misc_feature (36): n=a or c
aatgaaatacgtttctttgtccttatgtttattctntgcatgaaaaaccgctattatagaagtagaataga

SEQ ID NO: 43518 - DNA, 71 bp, chicken (Gallus Gallus)
  misc_feature (36): n=c or t
agaatttccttccagaacagtgccataaaggattanagtgctatttaggaggtggagaagtgccaacagtt

SEQ ID NO: 43519 - DNA, 71 bp, chicken (Gallus Gallus)
  misc_feature (36): n=c or t
actggtaaaattcaggcaaagtgaataataaatatncaaaggacttctcaaaagtgggaaataatttttga

SEQ ID NO: 43520 - DNA, 71 bp, chicken (Gallus Gallus)
  misc_feature (36): n=a or g
gacaagacatcacccaggactgccaaaagttagctntttactgctgacacccagacatgagctcagaacca

SEQ ID NO: 43521 - DNA, 71 bp, chicken (Gallus Gallus)
  misc_feature (36): n=a or g
aaggaatccttgataccatgacctttgtgtaatgancaaaagatgtatcaaattacacaaagttaaaattt

SEQ ID NO: 43522 - DNA, 71 bp, chicken (Gallus Gallus)
  misc_feature (36): n=g or t
tgaaataggttccacttttcacatcattgtgctcanataaagtacaggaagcaacacacatgcacgcataa

SEQ ID NO: 43523 - DNA, 71 bp, chicken (Gallus Gallus)
  misc_feature (36): n=c or t
aagattctccatgcaaacatccactataaccacagnctgtgtttggtgaataatatagaagcatttttact

SEQ ID NO: 43524 - DNA, 71 bp, chicken (Gallus Gallus)
  misc_feature (36): n=a or c
atttctaaaactgttttctaattaacctttttgccncttctatttctaactttctttgcagaagtcagttt

SEQ ID NO: 43525 - DNA, 71 bp, chicken (Gallus Gallus)
  misc_feature (36): n=c or t
ttccagtctagtgcttcacttcattcaaatctttcntaacacttatttacaatatcaataaatgagatcat

SEQ ID NO: 43526 - DNA, 71 bp, chicken (Gallus Gallus)
  misc_feature (36): n=c or t
catatctaatatatgtcattccacttccgcagtcangttatgtaagggggtttattcacactattatttgg

SEQ ID NO: 43527 - DNA, 71 bp, chicken (Gallus Gallus)
  misc_feature (36): n=a or c
tcagccatacttgactgggctatataactgtcctancatgcttaactaggcttgtaaaatctcagctcatc

SEQ ID NO: 43528 - DNA, 71 bp, chicken (Gallus Gallus)
  misc_feature (36): n=a or c
ctacagaaataactgctgtttttgctactgatttcnctgcagtgcagactagaaatctcttactgatattt

SEQ ID NO: 43529 - DNA, 71 bp, chicken (Gallus Gallus)
  misc_feature (36): n=c or t
taaaggagaaaatctgaattctgagtataatagaancaagaacctcatcaggagaagcatctcatcaccat

SEQ ID NO: 43530 - DNA, 71 bp, chicken (Gallus Gallus)
  misc_feature (36): n=a or g
tgcttgcagactgtatggaaattgctgctgagcagncaaatatctgccaaaatcctatatctgacctgagg

SEQ ID NO: 43531 - DNA, 71 bp, chicken (Gallus Gallus)
  misc_feature (36): n=c or t
gataagagcctgtgtagagtgatggtgcctttggtnttaatccctgggacaatacttgcccaaaccctcag

SEQ ID NO: 43532 - DNA, 71 bp, chicken (Gallus Gallus)
  misc_feature (36): n=c or t
agtagacataagcactgtgcaactatactataacanaacatctctaaattttttaccaggtattcgcttag

SEQ ID NO: 43533 - DNA, 71 bp, chicken (Gallus Gallus)
  misc_feature (36): n=g or t
ccagaaagcccactctcatgtcatgccaggtgggtnccactcctttggattgagagccaggagctctttcc

SEQ ID NO: 43534 - DNA, 71 bp, chicken (Gallus Gallus)
  misc_feature (36): n=a or g
tcttacttggcctctacatccgacctcaggtacacngtgaaagtctcagtgtcatcatgggggcttcgtcg

SEQ ID NO: 43535 - DNA, 71 bp, chicken (Gallus Gallus)
  misc_feature (36): n=a or g
gcaagatttttgcaagattttgcaagattccttcancaaccatcttcagatcaagattttctaagaaacat

SEQ ID NO: 43536 - DNA, 71 bp, chicken (Gallus Gallus)
  misc_feature (36): n=c or t
tacataagtaaattagtaaaatcttttctcacaaancaacccaacaaactaaataatagaaagtcaccctt

SEQ ID NO: 43537 - DNA, 71 bp, chicken (Gallus Gallus)
  misc_feature (36): n=a or g
cagctctctgccaggcacagcgtgtccccctctgtnggcttattggcagcagggacccctgcagagaaaac

SEQ ID NO: 43538 - DNA, 71 bp, chicken (Gallus Gallus)
  misc_feature (36): n=a or g
ctttagtgttcctgaaccactctgaaatggcacacnggggcttttaaataagcaattgtgcagcatcactc

SEQ ID NO: 43539 - DNA, 71 bp, chicken (Gallus Gallus)
  misc_feature (36): n=c or t
ggcacagccttggagacaacacttttgctgggagangtgcggcctgtcgaaccactgggctctaattcagt

SEQ ID NO: 43540 - DNA, 71 bp, chicken (Gallus Gallus)
  misc_feature (36): n=a or g
tctacttattcccccccactacctattattagtganacatgacctcagctgggccattaaaagcaaaaagg

SEQ ID NO: 43541 - DNA, 71 bp, chicken (Gallus Gallus)
  misc_feature (36): n=c or t
ccaaacaagagcaatcagactttctatgtacctgcnccacttcggaaaaagaaagctgaacgagaagagta

SEQ ID NO: 43542 - DNA, 71 bp, chicken (Gallus Gallus)
  misc_feature (36): n=a or g
ttgattataataatttctcttcaggctttatgtacntaaacatctttcaggtatgtagtttagcactgcca

SEQ ID NO: 43543 - DNA, 71 bp, chicken (Gallus Gallus)
  misc_feature (36): n=a or g
gaacaataattacaatcttttgcacatttttcctcngaggatctccaggcacaagcacatcctttggagat

SEQ ID NO: 43544 - DNA, 71 bp, chicken (Gallus Gallus)
  misc_feature (36): n=a or g
ttccagaatctggttcaagtcaaaggacattgtctncattaacatttcaaaagtgcgtgattgctcttaaa

SEQ ID NO: 43545 - DNA, 71 bp, chicken (Gallus Gallus)
  misc_feature (36): n=g or t
cccaatggtaacaagctccacaactgatcataaatnttcaggaatgctttcatcccacctcatcctgtgat

SEQ ID NO: 43546 - DNA, 71 bp, chicken (Gallus Gallus)
  misc_feature (36): n=c or t
aagtaggttcaaataattgctttaagtttattcagngattgaacgtttttaccacaccgaggaagctgatt

SEQ ID NO: 43547 - DNA, 71 bp, chicken (Gallus Gallus)
  misc_feature (36): n=c or t
tgataggatgtgtcaaaggacctctccaactctctntacacaccacacctatgtagaaatgtgggaagaat

SEQ ID NO: 43548 - DNA, 71 bp, chicken (Gallus Gallus)
  misc_feature (36): n=a or g
gtggatgtgccatagaaagatatacttaaaaagaancccaaattcaataacttcttgaatagattaactct

SEQ ID NO: 43549 - DNA, 71 bp, chicken (Gallus Gallus)
  misc_feature (36): n=a or g
gtttaaggattggacacagtaatgtcattacacttntgacctaacaatcttatgaacagctgatagaaata

SEQ ID NO: 43550 - DNA, 71 bp, chicken (Gallus Gallus)
  misc_feature (36): n=a or c
gagcactgggtgcctaaagaaaaaatcctcacaacnaatacctggtcgtcagaactctctaaactggttag

SEQ ID NO: 43551 - DNA, 71 bp, chicken (Gallus Gallus)
  misc_feature (36): n=a or g
gaagcaatttgccagcctgtatataataacctaaancatgtatctatttcttctttagagaacaggaagca

SEQ ID NO: 43552 - DNA, 71 bp, chicken (Gallus Gallus)
  misc_feature (36): n=a or g
ttttaccacacctggactttctgctgaatatatagnaaacttcagacctaacttaggcatcgagtctgcag

SEQ ID NO: 43553 - DNA, 71 bp, chicken (Gallus Gallus)
  misc_feature (36): n=c or t
tataataatagtaaattaggttaatttggtattcantagccataatgacaaatatgtcatttggataagtt

SEQ ID NO: 43554 - DNA, 71 bp, chicken (Gallus Gallus)
  misc_feature (36): n=c or t
aagaggagtccttagaagtgaaacagccaatagttngataggctgcaagacgtgcatatttgatgataata

SEQ ID NO: 43555 - DNA, 71 bp, chicken (Gallus Gallus)
  misc_feature (36): n=c or t
ttatcagctgttaattaaaaactggattgtgtaacngctgattactaagcagtacaatttaaagagtaaaa

SEQ ID NO: 43556 - DNA, 71 bp, chicken (Gallus Gallus)
  misc_feature (36): n=a or g
gcagggcatttccattacctcaggtttttcttcagntgggatgccatcacataagtcttcagacattttca

SEQ ID NO: 43557 - DNA, 71 bp, chicken (Gallus Gallus)
  misc_feature (36): n=c or t
aattccctggacgctgcgtggttgaacttcaccgancccgctgcaacgtggtgctacactcggtgacgata

SEQ ID NO: 43558 - DNA, 71 bp, chicken (Gallus Gallus)
  misc_feature (36): n=c or t
caacgctcatgcagttctgggagctgtgtgggtagngtcaacccacaggtcctcgtgaaaggcttttctag

SEQ ID NO: 43559 - DNA, 71 bp, chicken (Gallus Gallus)
  misc_feature (36): n=g or t
agcatagtatatttgtaccatctgcctgccaagtcnctgcactatcagcatttaactcattatttgtcagt

SEQ ID NO: 43560 - DNA, 71 bp, chicken (Gallus Gallus)
  misc_feature (36): n=a or g
ccagcccacgatcagtttctcaacttcttctgcctngatgacagcttaaatttacacatactgtaaatgaa

SEQ ID NO: 43561 - DNA, 71 bp, chicken (Gallus Gallus)
  misc_feature (36): n=a or g
cttttagttaggagtaaacaatttctggttctgccnaaaagaggctgaaatgaactctggtacctcaagag

SEQ ID NO: 43562 - DNA, 71 bp, chicken (Gallus Gallus)
  misc_feature (36): n=a or g
aactgaaaaggaatctgtgaacttaaaagaaagccnggtcaacacttactgctcacagatctcagtgtctg

SEQ ID NO: 43563 - DNA, 71 bp, chicken (Gallus Gallus)
  misc_feature (36): n=a or g
gttttgagttgggtatgtgcaacatgacaaatactntgatggctccctaaatgctattcaaaaataggctg

SEQ ID NO: 43564 - DNA, 71 bp, chicken (Gallus Gallus)
  misc_feature (36): n=a or g
taattagatggttatgaagttactatctgatgtaanagacttattataatcctatgggaaaaaaaaacaaa

SEQ ID NO: 43565 - DNA, 71 bp, chicken (Gallus Gallus)
  misc_feature (36): n=a or g
tcaaatagtaacatcagtaaagaacttcagtgaatncatcagtatgtctagtagtacagtaggtttcactc

SEQ ID NO: 43566 - DNA, 71 bp, chicken (Gallus Gallus)
  misc_feature (36): n=c or t
ctaggcattaaatttggatgtcagagataagagcanaaacaccttactttacataaatcctgtacaaaatt

SEQ ID NO: 43567 - DNA, 71 bp, chicken (Gallus Gallus)
  misc_feature (36): n=a or g
ataaatcttgtccataatgtcttaaatacgtggagntaacagaagagttagtgaactttcatccttatttg

SEQ ID NO: 43568 - DNA, 71 bp, chicken (Gallus Gallus)
  misc_feature (36): n=g or t
ttttaattggatatcattgtgtccctacaggaaatngcaattcctttatagttatttcattgaagcaaaac

SEQ ID NO: 43569 - DNA, 71 bp, chicken (Gallus Gallus)
  misc_feature (36): n=g or t
ctagtcttgtacctgtacatgctgaaaacatataancatctatttcaaggctaaaagacatctttagatca

SEQ ID NO: 43570 - DNA, 71 bp, chicken (Gallus Gallus)
  misc_feature (36): n=c or t
ttcttttttgtgtctttaacatattctgagaaatgngagggtagctgtgaagtgtcaaaaggacttagtgt

SEQ ID NO: 43571 - DNA, 71 bp, chicken (Gallus Gallus)
  misc_feature (36): n=c or t
aaaatatctcgatcactagatgatagacaccactgnaattcatcactgaagcaattcaatttcatagtttt

SEQ ID NO: 43572 - DNA, 71 bp, chicken (Gallus Gallus)
  misc_feature (36): n=a or g
atgattaaagctaagaatgtctaagtacatttcacnaattttgccctaagtaaaatgtaattccagggcaa

SEQ ID NO: 43573 - DNA, 71 bp, chicken (Gallus Gallus)
  misc_feature (36): n=a or c
ctgaatggaactaaactggaggctttttcaaagaanggagagacacgtaatatgagcagatagtctgacct

SEQ ID NO: 43574 - DNA, 71 bp, chicken (Gallus Gallus)
  misc_feature (36): n=a or c
agggtttttagtgcgtaacgtagcatggttgttgcnataccagaaaagcttcccaactgtaagcagtatgt

SEQ ID NO: 43575 - DNA, 71 bp, chicken (Gallus Gallus)
  misc_feature (36): n=a or g
ctagtttaagcattagtgtactgctctgtttcagcnctactttcagtgtgtgatctatggctacaagaaac

SEQ ID NO: 43576 - DNA, 71 bp, chicken (Gallus Gallus)
  misc_feature (36): n=g or t
agtacagtgaaggagtacctgtcttgtttttctctntccagctttctcactgctgtcagaatgcctgtacg

SEQ ID NO: 43577 - DNA, 71 bp, chicken (Gallus Gallus)
  misc_feature (36): n=g or t
gctaagatagctgtttctattttgcaggttaacatntttagatcaaccgcgtccatcatgtcttaggacat

SEQ ID NO: 43578 - DNA, 71 bp, chicken (Gallus Gallus)
  misc_feature (36): n=c or t
gataaatgacgaaggtgaaacaatttaaaattgaanagctatacatacgtttgcatgtttatccacatact

SEQ ID NO: 43579 - DNA, 71 bp, chicken (Gallus Gallus)
  misc_feature (36): n=a or g
ttggctttaactgactgtataattttagctcttcantggggacaagtataaagtcatatacctggagagga

SEQ ID NO: 43580 - DNA, 71 bp, chicken (Gallus Gallus)
  misc_feature (36): n=a or g
gatgccgactttgtggtagatctgaatactttttcnttctacttctgtaataacaggcaattattttgcca

SEQ ID NO: 43581 - DNA, 71 bp, chicken (Gallus Gallus)
  misc_feature (36): n=a or g
agcaagcctattcggttgaactggcacaggtttgcncatccttttttgcatgcagtcagctgacgaaggaa

SEQ ID NO: 43582 - DNA, 71 bp, chicken (Gallus Gallus)
  misc_feature (36): n=a or g
agtacaagtacctaaattgcagtcctaatcttgacnttgtaatgcatgttagcagaaacttctgcttgcac

SEQ ID NO: 43583 - DNA, 71 bp, chicken (Gallus Gallus)
  misc_feature (36): n=c or t
aattcttgtttactagaagtcacaaatgtaaattcntcatgtatctacggtaatcagttttgctctaacag

SEQ ID NO: 43584 - DNA, 71 bp, chicken (Gallus Gallus)
  misc_feature (36): n=a or g
aactattgctgcggtgtttctttagaactgcattanagaaaatatgcctctttgtgttagctgaattaaca

SEQ ID NO: 43585 - DNA, 71 bp, chicken (Gallus Gallus)
  misc_feature (36): n=a or c
agagtttcatttgaagttctttcagaatttgctcanctatgtggactacatttccttaatagcagttgttt

SEQ ID NO: 43586 - DNA, 71 bp, chicken (Gallus Gallus)
  misc_feature (36): n=a or c
gtttgctcggtcttgtccctacttaatagagccctnccagatctagagcaagtttctgtggttctgtcatg

SEQ ID NO: 43587 - DNA, 71 bp, chicken (Gallus Gallus)
  misc_feature (36): n=c or t
tctttttttttggaaattgatgtctattttttcttncacgtgtctttacatagcaacttgtagacgctaat

SEQ ID NO: 43588 - DNA, 71 bp, chicken (Gallus Gallus)
  misc_feature (36): n=a or g
gagattgttgcttttatgctgttgtgtgtagctaanattaaataataacccttctactcaaacagggcatg

SEQ ID NO: 43589 - DNA, 71 bp, chicken (Gallus Gallus)
  misc_feature (36): n=c or t
atctttagtaaaaactcaatacttcgtaataaccantgctttcatgaaagtttaggacagtatctaatacc

SEQ ID NO: 43590 - DNA, 71 bp, chicken (Gallus Gallus)
  misc_feature (36): n=g or t
tacataataaggtgtgtttgcatgtttacaaataantaaatttgcctacctcttattattgggctggacat

SEQ ID NO: 43591 - DNA, 71 bp, chicken (Gallus Gallus)
  misc_feature (36): n=a or g
gtatattatattgtttgaagtaatagaacacacacnaagtgcaaatgtaatattaaagaagaatccaaggg

SEQ ID NO: 43592 - DNA, 71 bp, chicken (Gallus Gallus)
  misc_feature (36): n=c or t
agcgaatttgctggagtgcctccagggatgcactangcgcagttggatgttgtgacaaataatatttcagc

SEQ ID NO: 43593 - DNA, 71 bp, chicken (Gallus Gallus)
  misc_feature (36): n=a or g
tgattgaactgagacatttttgattcaagagaaagnccatctcctgtgacggataatttttaaataacttt

SEQ ID NO: 43594 - DNA, 71 bp, chicken (Gallus Gallus)
  misc_feature (36): n=a or g
gtcaaggctataaaaagaaatcttagaaaatcacanaatttgggactctggtgatggttgttgtgacaagt

SEQ ID NO: 43595 - DNA, 71 bp, chicken (Gallus Gallus)
  misc_feature (36): n=a or g
atgtactatacatcttagaatttctggtcattgatngctatactgtacttcgttaattctatttctgtatc

SEQ ID NO: 43596 - DNA, 71 bp, chicken (Gallus Gallus)
  misc_feature (36): n=a or g
atcatcctgattttatgactttgtttcttaagtcantgctggtttaagcttactgcagctgtgaagtgaat

SEQ ID NO: 43597 - DNA, 71 bp, chicken (Gallus Gallus)
  misc_feature (36): n=c or t
gtatttgcactgttttgccaaatgcttgcagtaggngcttcatagcaaacacaataattatttgtaactaa

SEQ ID NO: 43598 - DNA, 71 bp, chicken (Gallus Gallus)
  misc_feature (36): n=g or t
attctaccagacaacagttttgcacttataaagagncaagagatatctggacacgtgacccctctcctagt

SEQ ID NO: 43599 - DNA, 71 bp, chicken (Gallus Gallus)
  misc_feature (36): n=g or t
tgctactgcacagttttacacattatttctcagcanagaaaagctccctcattcatgagaaagctatactg

SEQ ID NO: 43600 - DNA, 71 bp, chicken (Gallus Gallus)
  misc_feature (36): n=a or c
ttaaggaacagcatacactgaatgacaaaataatcnttattttaatatagtcatctattgcaaatacaaat

SEQ ID NO: 43601 - DNA, 71 bp, chicken (Gallus Gallus)
  misc_feature (36): n=c or t
cagttggaatgggctgatacctttcaatagaatagnctgaacgacatcagtctgggttgtgttctccttct

SEQ ID NO: 43602 - DNA, 71 bp, chicken (Gallus Gallus)
  misc_feature (36): n=c or t
agatggtgttatgcaatttctgttccactcaccctntttttgaataaatactactgcagttgaatcatatg

SEQ ID NO: 43603 - DNA, 71 bp, chicken (Gallus Gallus)
  misc_feature (36): n=c or t
ctttatcctactgctgttagaaatctgtattagagntaaaatactgaaatatgacacctcatatggaggaa

SEQ ID NO: 43604 - DNA, 71 bp, chicken (Gallus Gallus)
  misc_feature (36): n=g or t
ccttgggctttaagtactgagatgagctacgttcanagcagagtttgtttcatcgtctgtgtctgagatag

SEQ ID NO: 43605 - DNA, 71 bp, chicken (Gallus Gallus)
  misc_feature (36): n=a or c
ctgcatatctatcactagaagactacacttctaaanctaggattggaacatacagttatgtaacaggtgag

SEQ ID NO: 43606 - DNA, 71 bp, chicken (Gallus Gallus)
  misc_feature (36): n=a or g
tgagtatgaattgagggtttctgatgcaagacaaanagttgctttccctgagacagctagaagcaatcttt

SEQ ID NO: 43607 - DNA, 71 bp, chicken (Gallus Gallus)
  misc_feature (36): n=c or t
ctggccaaacacaggagggttgtcattagtgtctgngacccgcaccagcaaggagttgttgctggacaagc

SEQ ID NO: 43608 - DNA, 71 bp, chicken (Gallus Gallus)
  misc_feature (36): n=a or g
atcttagataaggtcagacgttatgataatcatcantgatgacctaaggaatttaactcatacttctaact

SEQ ID NO: 43609 - DNA, 71 bp, chicken (Gallus Gallus)
  misc_feature (36): n=a or g
ccagctttctcctctgctagtttgaactcagttatnttctacctctcaatgatagcagtagcaaaaggagc

SEQ ID NO: 43610 - DNA, 71 bp, chicken (Gallus Gallus)
  misc_feature (36): n=g or t
attttatcttcatgatcttaattttttcagagtctngttataagcagaaatgatgcagatgacaaatcact

SEQ ID NO: 43611 - DNA, 71 bp, chicken (Gallus Gallus)
  misc_feature (36): n=a or g
aaaaataacataactagatgaaattgtggtcaagtnttgcaatacaatatgaaattttacaccaaagttga

SEQ ID NO: 43612 - DNA, 71 bp, chicken (Gallus Gallus)
  misc_feature (36): n=a or g
tatattgagtagattcagcccattgtgtaataaaanatatgagatacacagattgaggtattctttcatgc

SEQ ID NO: 43613 - DNA, 71 bp, chicken (Gallus Gallus)
  misc_feature (36): n=a or g
atcatgacatgtaacaatcatctactttcatgaagnactgaaaggtaattactattctggaattaatgtaa

SEQ ID NO: 43614 - DNA, 71 bp, chicken (Gallus Gallus)
  misc_feature (36): n=c or t
ggcttctgctctcacttatgccttctaggtgtgaangcttgttaatttgctaacacttatttttcttcagc

SEQ ID NO: 43615 - DNA, 71 bp, chicken (Gallus Gallus)
  misc_feature (36): n=a or g
tacaaactaaaaatattgctgtgtttcagaatccgntattaatgtaggctgcattagtgtgcacatagcat

SEQ ID NO: 43616 - DNA, 71 bp, chicken (Gallus Gallus)
  misc_feature (36): n=a or g
acactgaaatcaatagaaatatgaactgaagtttcntgtgtttcaggattgttggagattaagaacgcata

SEQ ID NO: 43617 - DNA, 71 bp, chicken (Gallus Gallus)
  misc_feature (36): n=c or t
ctctaggacataaatattcttcattaagttatctanctgagctgtgtcctcaaagaatggttcagcctaca

SEQ ID NO: 43618 - DNA, 71 bp, chicken (Gallus Gallus)
  misc_feature (36): n=a or g
aaatataaaatgtagatgagtttttcttttggtgancttggaaatattaattcttatgttcctgctgctgt

SEQ ID NO: 43619 - DNA, 71 bp, chicken (Gallus Gallus)
  misc_feature (36): n=c or t
actaaaatatgactgttgaataaactgatgaattcngtcatacggcataaagaacacaaacttgtagttca

SEQ ID NO: 43620 - DNA, 71 bp, chicken (Gallus Gallus)
  misc_feature (36): n=a or g
gtacatgcaaatgaaactcagtggaaacagacttanagggtttttctatttacaaatccatacacaaaaag

SEQ ID NO: 43621 - DNA, 71 bp, chicken (Gallus Gallus)
  misc_feature (36): n=a or g
gctaatttgctgagtgtgggtgcctatgggaagttntgtatactccactcaagcctatatggtttgatttg

SEQ ID NO: 43622 - DNA, 71 bp, chicken (Gallus Gallus)
  misc_feature (36): n=a or c
ttttgcatcatgtgtgctaaccccagtttctgggtnaagtattctaataacactgaattgtaaccttaaat

SEQ ID NO: 43623 - DNA, 71 bp, chicken (Gallus Gallus)
  misc_feature (36): n=g or t
acaccttgtatgaaaatcttgggactaaaagtaaangtcacctgaagtagattggtttggttttaagtccc

SEQ ID NO: 43624 - DNA, 71 bp, chicken (Gallus Gallus)
  misc_feature (36): n=a or g
tcagaaaactgtgctatacatactacgtatctatcngattttaaaaggtgaatttatatgaaacaactctc

SEQ ID NO: 43625 - DNA, 71 bp, chicken (Gallus Gallus)
  misc_feature (36): n=c or t
ggtaaacattagcaaattataacaaattaacaaatnattttacagcaattttattcatgcaaacatatgag

SEQ ID NO: 43626 - DNA, 71 bp, chicken (Gallus Gallus)
  misc_feature (36): n=a or g
taatttaagtaactggaattctttacataatacatntaccactgtgaacaagttacactcttgaaaggaaa

SEQ ID NO: 43627 - DNA, 71 bp, chicken (Gallus Gallus)
  misc_feature (36): n=g or t
attctacataattacagggtattttgctcacatganttgcgtattttctgtattattcaggggacaaaact

SEQ ID NO: 43628 - DNA, 71 bp, chicken (Gallus Gallus)
  misc_feature (36): n=c or t
caacagctagaaggatgatgagggaaaataaattgntacttcaggttcaggtttctcagttatgactatat

SEQ ID NO: 43629 - DNA, 71 bp, chicken (Gallus Gallus)
  misc_feature (36): n=a or g
aagaattaagtactgatacccattaagcgtatatgnaagacactttggaagttgctgtcaatattctccct

SEQ ID NO: 43630 - DNA, 71 bp, chicken (Gallus Gallus)
  misc_feature (36): n=a or c
ccctttgaggaccagcaagaactgaacctactcccnctctaaagtgcttcatacagtctatgcgacaatca

SEQ ID NO: 43631 - DNA, 71 bp, chicken (Gallus Gallus)
  misc_feature (36): n=a or g
tattaaactcgaagtctcactacataatttaggaancatgttatcactgctattctgcttcagaaatgagg

SEQ ID NO: 43632 - DNA, 71 bp, chicken (Gallus Gallus)
  misc_feature (36): n=g or t
gctgtacagtgtacagttctactactgggatgggangtaaagaaaggacccagcttaggtcttcagttatc

SEQ ID NO: 43633 - DNA, 71 bp, chicken (Gallus Gallus)
  misc_feature (36): n=c or t
ccatttggattgccatagctcaggtgactttatagngcagctgcttgtacaagcacaaaatccagtttctg

SEQ ID NO: 43634 - DNA, 71 bp, chicken (Gallus Gallus)
  misc_feature (36): n=c or t
ctgtggaaaacaaattgatttcgtcctgtatcttanggatgtcctcaagatatttaaattggtgaagagac

SEQ ID NO: 43635 - DNA, 71 bp, chicken (Gallus Gallus)
  misc_feature (36): n=a or g
agcaagagggagggaagcaaaggatcataggcctgnaatgaatctctaggcaccttccaatctatttgctc

SEQ ID NO: 43636 - DNA, 71 bp, chicken (Gallus Gallus)
  misc_feature (36): n=a or g
tagctatatcatcaatgttgcacttcaaaagaatanatgcacactagagccaatctagcttcaatgcaaga

SEQ ID NO: 43637 - DNA, 71 bp, chicken (Gallus Gallus)
  misc_feature (36): n=c or t
ataggagagggtaaaaagggtgcaatgagtctgagnacagaagagcaagggagtaacacacacgtactgtc

SEQ ID NO: 43638 - DNA, 71 bp, chicken (Gallus Gallus)
  misc_feature (36): n=c or t
agtgcagaatgttaaatgtggtgcatatgttttggnagaaatgggacttaatgttgcaattttgcatagtc

SEQ ID NO: 43639 - DNA, 71 bp, chicken (Gallus Gallus)
  misc_feature (36): n=c or t
aaatacatagtccttgttaatcgatttctctagccnatttaatatttgctggttttgctgtccttcatgac

SEQ ID NO: 43640 - DNA, 71 bp, chicken (Gallus Gallus)
  misc_feature (36): n=a or g
tcagatataaaagaagagatgacccaggaaatgcantgaaaactgagagtggctgagtgataaaggcacta

SEQ ID NO: 43641 - DNA, 71 bp, chicken (Gallus Gallus)
  misc_feature (36): n=a or g
gttaaaacccattttttaaattcaactcagagtaanaccaaatcagactttggggagtataacagtgggca

SEQ ID NO: 43642 - DNA, 71 bp, chicken (Gallus Gallus)
  misc_feature (36): n=a or g
actgtgttttaaaaaacaatgagaggtgtgctcacntggaaggacttagagcgggcaaattaagaggtaaa

SEQ ID NO: 43643 - DNA, 71 bp, chicken (Gallus Gallus)
  misc_feature (36): n=a or g
gcaacaagagcacctatcactgaatgttcagtggtngccattatacaatgtaataagcagtgcctgctgat

SEQ ID NO: 43644 - DNA, 71 bp, chicken (Gallus Gallus)
  misc_feature (36): n=g or t
tttttcctgagcaatatcccgcaccacccagttccncagatgaattaaccagtgggcagacacatctcgct

SEQ ID NO: 43645 - DNA, 71 bp, chicken (Gallus Gallus)
  misc_feature (36): n=a or g
ttgagtgtcctttgaatgactgcagcttcccttcancatgcttctgaaatcgtagttatacaaaggaattt

SEQ ID NO: 43646 - DNA, 71 bp, chicken (Gallus Gallus)
  misc_feature (36): n=c or t
cattgtaaaatatgaagtttcaggacatgaattagntttcaaataccatagatgcatattaaaaaaaagca

SEQ ID NO: 43647 - DNA, 71 bp, chicken (Gallus Gallus)
  misc_feature (36): n=g or t
atgatacaggatatgtcttattttcagagatttttnaagaatcccttgtgagaatagaacctctagttgag

SEQ ID NO: 43648 - DNA, 71 bp, chicken (Gallus Gallus)
  misc_feature (36): n=a or g
ttcacagaagaagaaattgataaaagccaaaaaganaaacacacttggttaatttttcagtctacatgacg

SEQ ID NO: 43649 - DNA, 71 bp, chicken (Gallus Gallus)
  misc_feature (36): n=c or t
acttccatgtttaataaagcaaagatcatactatangtaaagcgtgagcatgaagaaaaaatatacagact

SEQ ID NO: 43650 - DNA, 71 bp, chicken (Gallus Gallus)
  misc_feature (36): n=c or t
ctggctttatgggataccaaactacactgacaatgnaccttatagagctaatgctaatggaagcttctaat

SEQ ID NO: 43651 - DNA, 71 bp, chicken (Gallus Gallus)
  misc_feature (36): n=a or g
tccaaactccatgaactagaagcttgctttgtggantgaatcttttctcagcttctgttgcttgacctgaa

SEQ ID NO: 43652 - DNA, 71 bp, chicken (Gallus Gallus)
  misc_feature (36): n=c or t
acaggagctttccatacttctggatgagatcagctncctgggagttaggctataatttcctatgctttatt

SEQ ID NO: 43653 - DNA, 71 bp, chicken (Gallus Gallus)
  misc_feature (36): n=a or g
cttaggatcaatattagcattagactgaatcaaagntaatgttcaagtataaattgtaaatcttccagaag

SEQ ID NO: 43654 - DNA, 71 bp, chicken (Gallus Gallus)
  misc_feature (36): n=c or t
aaccaaaaagtttcaaaggacaaaaactgtgcttangcttgcgtgtcttttgggaggctgactgagagtat

SEQ ID NO: 43655 - DNA, 71 bp, chicken (Gallus Gallus)
  misc_feature (36): n=c or t
tttgagatgctgtcctgaccaccacccccagacctntgacaaactagcttttatagcaagagataacatag

SEQ ID NO: 43656 - DNA, 71 bp, chicken (Gallus Gallus)
  misc_feature (36): n=a or g
agtaaaacagcaagcaggagagaccatcaaaaggcngaatcatatttattattctctatctcttctttctg

SEQ ID NO: 43657 - DNA, 71 bp, chicken (Gallus Gallus)
  misc_feature (36): n=g or t
atgtatttcaaaaggcaagagtagctttctgaaaanatttccatgcccaaatggtagaaaagtagaaactt

SEQ ID NO: 43658 - DNA, 71 bp, chicken (Gallus Gallus)
  misc_feature (36): n=a or g
ggatgtttatattagtacttactagttatatggaanttaaggtgtctcaaaatctactccccattccttct

SEQ ID NO: 43659 - DNA, 71 bp, chicken (Gallus Gallus)
  misc_feature (36): n=c or t
ttattaccaacttcagctatgcaggcccagaccaanaaggatacaagttctgcatagtagcatgatgcttt

SEQ ID NO: 43660 - DNA, 71 bp, chicken (Gallus Gallus)
  misc_feature (36): n=c or t
gcagacactggcagaataagcacttcttgggaatgnggaggaggaggaatgaccgagaggttccacgtggg

SEQ ID NO: 43661 - DNA, 71 bp, chicken (Gallus Gallus)
  misc_feature (36): n=g or t
actagatctttcatttcattagttctagaatgatgnagataaaagtagttcagcatctttagtccattaaa

SEQ ID NO: 43662 - DNA, 71 bp, chicken (Gallus Gallus)
  misc_feature (36): n=a or g
gaaaaggcaacttgtggtctgaaccctgtgttaccnttaatgacgataggctttacattctttaattgtta

SEQ ID NO: 43663 - DNA, 71 bp, chicken (Gallus Gallus)
  misc_feature (36): n=c or t
ctcagtgtcctagaaatgcacagcagagctccgttntcatccagcatcactctgaagtagagcacaaaaca

SEQ ID NO: 43664 - DNA, 71 bp, chicken (Gallus Gallus)
  misc_feature (36): n=a or c
ttcctttgtactgtttcaagctccacttatcctggnacctgaaaataatgggcataaattaaagtataatt

SEQ ID NO: 43665 - DNA, 71 bp, chicken (Gallus Gallus)
  misc_feature (36): n=a or g
caaagatatatatatacacctttacaaagtacaacnttaaaatgataaaacattgacagccatgctcagat

SEQ ID NO: 43666 - DNA, 71 bp, chicken (Gallus Gallus)
  misc_feature (36): n=a or g
gcaaagacagcttttgctgtcaggaatccttttctngaaagatggcaggtacatttcccttgaaaatgggg

SEQ ID NO: 43667 - DNA, 71 bp, chicken (Gallus Gallus)
  misc_feature (36): n=c or t
tcccctgcagtataaccataagcagcagaacaaccncctcccaaagacaaatgtgtcccgttttcacgatt

SEQ ID NO: 43668 - DNA, 71 bp, chicken (Gallus Gallus)
  misc_feature (36): n=a or g
tgattattagtctaggctattattaaaacaagccancaaaatacactacgaactatgaaagaaaaaagaca

SEQ ID NO: 43669 - DNA, 71 bp, chicken (Gallus Gallus)
  misc_feature (36): n=c or t
gagaaagaggtgacactggatttcccctagatacanttgaaaaaagactacatcatctgtgcttgtgtgag

SEQ ID NO: 43670 - DNA, 71 bp, chicken (Gallus Gallus)
  misc_feature (36): n=a or g
cagatgagggcgtagcagggaagaatgaagacatgncagaaattgtaagtattgtataacacacagaagat

SEQ ID NO: 43671 - DNA, 71 bp, chicken (Gallus Gallus)
  misc_feature (36): n=a or g
gtccagagctttactaaaaccagcaaagctatcccnatttatatcaacggaacatctagtttaaaacaagg

SEQ ID NO: 43672 - DNA, 71 bp, chicken (Gallus Gallus)
  misc_feature (36): n=c or t
ggaaccaattctttaacagtgaactgaccaggatcnttaatttactcctgacagttaaatgacaaatgtga

SEQ ID NO: 43673 - DNA, 71 bp, chicken (Gallus Gallus)
  misc_feature (36): n=a or g
tattaattgaaagctgtttttcataaattgtatcangtatctgcagttcatggttatgcctttaaatttcg

SEQ ID NO: 43674 - DNA, 71 bp, chicken (Gallus Gallus)
  misc_feature (36): n=c or t
tgtatttctaattgtgattattattagaagtagagntatttaaccacatatgtggtatttccaattttttc

SEQ ID NO: 43675 - DNA, 71 bp, chicken (Gallus Gallus)
  misc_feature (36): n=a or c
acagtattaatagtctgaagcaattgttaggttttnatgtttttatggtgatagaagctgcgcatgttttc

SEQ ID NO: 43676 - DNA, 71 bp, chicken (Gallus Gallus)
  misc_feature (36): n=c or t
ttattttaaatgtaaacatgatcaacctcaattggncatcagcacaacttcagtagttcttccagtcctca

SEQ ID NO: 43677 - DNA, 71 bp, chicken (Gallus Gallus)
  misc_feature (36): n=a or c
accaggcagttcttggacagcatcaacagggactcntagcaagaaacagagtggggagtgatgcgtggtgc

SEQ ID NO: 43678 - DNA, 71 bp, chicken (Gallus Gallus)
  misc_feature (36): n=c or t
ggagccaggatagacacaagacatcctttatgaaanacactattataaaagggagtgggtacaaagggaag

SEQ ID NO: 43679 - DNA, 71 bp, chicken (Gallus Gallus)
  misc_feature (36): n=a or c
aactcagaggcagtcattgtcagcccagagccacanaagcaagctcacactgatccgtgcaagtttaacaa

SEQ ID NO: 43680 - DNA, 71 bp, chicken (Gallus Gallus)
  misc_feature (36): n=a or g
atctctttttcaccatatcttaccatctgctgccanttcattgcatttgttactgataacaaataattaat

SEQ ID NO: 43681 - DNA, 71 bp, chicken (Gallus Gallus)
  misc_feature (36): n=a or g
cattcctagaataaccccaggggtaatttataaagntggtaattagcacagaccaaaagcatttgacagag

SEQ ID NO: 43682 - DNA, 71 bp, chicken (Gallus Gallus)
  misc_feature (36): n=a or g
aaaaggaatcagaaacagcatcctcattgctaagtnatggctgtttagactgtgagatagtgctgcaactt

SEQ ID NO: 43683 - DNA, 71 bp, chicken (Gallus Gallus)
  misc_feature (36): n=a or g
acttttttttccctcagtcctaaatgagctgaatgnatttagtgcatttcagttaaaaacacaagaaccta

SEQ ID NO: 43684 - DNA, 71 bp, chicken (Gallus Gallus)
  misc_feature (36): n=c or t
agctccattcagcctccagcccagccttctgcctcngccacactgctgcaaagatgcagagaccttgccag

SEQ ID NO: 43685 - DNA, 71 bp, chicken (Gallus Gallus)
  misc_feature (36): n=a or g
gattcaagatagtttagccatgaggggaagtaagtnaaattgtttttagtggtttgttattttatagctca

SEQ ID NO: 43686 - DNA, 71 bp, chicken (Gallus Gallus)
  misc_feature (36): n=a or g
ttgtttcaccttcttcctcacaactttcagttccancatgtacttcctcactttgaggctcaccgtccctt

SEQ ID NO: 43687 - DNA, 71 bp, chicken (Gallus Gallus)
  misc_feature (36): n=a or g
gagcttgctttattgatgagtttactcccccttgtnattttcacaatcattttcagttactgaacacatta

SEQ ID NO: 43688 - DNA, 71 bp, chicken (Gallus Gallus)
  misc_feature (36): n=a or g
ttggtgcacctgtcctgctcattcctagtcacttgntgtagaagatatggcccacactgggctaactttag

SEQ ID NO: 43689 - DNA, 71 bp, chicken (Gallus Gallus)
  misc_feature (36): n=a or g
aatccagcacgttattgtaaaaattggctctccccnaacgctgttgtttaatatctggtcactaggtgtca

SEQ ID NO: 43690 - DNA, 71 bp, chicken (Gallus Gallus)
  misc_feature (36): n=c or t
tggtgtcaacttcaaaaagttcctattttcctgacngcttcagtcagctttccataaccataagatattaa

SEQ ID NO: 43691 - DNA, 71 bp, chicken (Gallus Gallus)
  misc_feature (36): n=c or t
ctcaaggtctgaacttacctgagattgggagatatnttttttcttgtctatgtattcatgtgcggatacag

SEQ ID NO: 43692 - DNA, 71 bp, chicken (Gallus Gallus)
  misc_feature (36): n=c or t
tggagcaggtaaatactgtattgctgtccatgtcantgttttgctcttgatacagtattgtggcctgcatg

SEQ ID NO: 43693 - DNA, 71 bp, chicken (Gallus Gallus)
  misc_feature (36): n=g or t
ttgtaattatccatgttgtttaaatgaataccaagnttctgaaccttagaacttaaagaactttattgcct

SEQ ID NO: 43694 - DNA, 71 bp, chicken (Gallus Gallus)
  misc_feature (36): n=a or g
ttctgtccttggtgatgtgtgctagatgcttcatgngctctgtgttgacctgacagtttctgatgggcctc

SEQ ID NO: 43695 - DNA, 71 bp, chicken (Gallus Gallus)
  misc_feature (36): n=c or t
gtgataataagctcattaggcgtcctgccagacgcngtgtctggaactgtaggtaataaaggtgggctttg

SEQ ID NO: 43696 - DNA, 71 bp, chicken (Gallus Gallus)
  misc_feature (36): n=a or g
acaaaaatcatgcaagtattaaaaaagagggcaaangagtattgtgattaaaatagacaactttttaacta

SEQ ID NO: 43697 - DNA, 71 bp, chicken (Gallus Gallus)
  misc_feature (36): n=a or g
cttaacgtggccttcaactctcacaataaatcactncttaccatcatgatgtccaataatgtaagtatata

SEQ ID NO: 43698 - DNA, 71 bp, chicken (Gallus Gallus)
  misc_feature (36): n=a or g
tgttgcagggcagtagttagaggtgtgaatcagtgnctgatctctgctggcagtcttctgccctgattctg

SEQ ID NO: 43699 - DNA, 71 bp, chicken (Gallus Gallus)
  misc_feature (36): n=a or g
ttttttccccctctctgtgttgagttcaatttgccntatcctgttagcatcagctcttctgcaacaaatac

SEQ ID NO: 43700 - DNA, 71 bp, chicken (Gallus Gallus)
  misc_feature (36): n=a or g
ttcttgtagttaaaagtttgtctcccttcttgaatncagaacaatgctaaaacacgagaacacagaaaaat

SEQ ID NO: 43701 - DNA, 71 bp, chicken (Gallus Gallus)
  misc_feature (36): n=g or t
gcagatacagcctttgaatggttacttatctcccantacgttatcataaccttttaaccggtggtgatgca

SEQ ID NO: 43702 - DNA, 71 bp, chicken (Gallus Gallus)
  misc_feature (36): n=a or g
tactgctgtgttcttctcatcaatccatatcctctnactgagagatgtgcaaactgcagtattagattaca

SEQ ID NO: 43703 - DNA, 71 bp, chicken (Gallus Gallus)
  misc_feature (36): n=a or c
ttttgaaaatctgaagtatctgtaagttttaccatnataaaattaatttacgactctaaatataaactttc

SEQ ID NO: 43704 - DNA, 71 bp, chicken (Gallus Gallus)
  misc_feature (36): n=a or g
tagcaggtaggtgaatttaagactccaacttgatcnttatgaccatcgtccaacaaaccatcatctattgg

SEQ ID NO: 43705 - DNA, 71 bp, chicken (Gallus Gallus)
  misc_feature (36): n=c or t
tagatgatgtaaaaatatgctgcctctaatgagtgntggttagactgctgccacagaagcattggagtttt

SEQ ID NO: 43706 - DNA, 71 bp, chicken (Gallus Gallus)
  misc_feature (36): n=c or t
agtacattgtgtacaggctttgtaaataaatgggantgcattggataaatgcctgactctgtcacctattc

SEQ ID NO: 43707 - DNA, 71 bp, chicken (Gallus Gallus)
  misc_feature (36): n=a or c
attcttagaagaggatgaagatattgcaagatgtcntcggacctaattacaactcaactattacaacttaa

SEQ ID NO: 43708 - DNA, 71 bp, chicken (Gallus Gallus)
  misc_feature (36): n=a or g
aatatgttttgagtaccttaaatattttcagtctcntggtagctacaggcagtgtaacattgtcagtgctt

SEQ ID NO: 43709 - DNA, 71 bp, chicken (Gallus Gallus)
  misc_feature (36): n=a or c
ctgcttatgaaaaagaagtaattcaatagaaatttnattcaaaggatgtgttggttaaacatgatggacaa

SEQ ID NO: 43710 - DNA, 71 bp, chicken (Gallus Gallus)
  misc_feature (36): n=a or g
actaataaatggctaaggcatcccagtctcccagtnataaaacctttacacagaactgcactaccgcgtgc

SEQ ID NO: 43711 - DNA, 71 bp, chicken (Gallus Gallus)
  misc_feature (36): n=a or c
aagccgatcagctatagctttaattagctttgccanaaagtaaaacagagtttaaatacatgtagagcaat

SEQ ID NO: 43712 - DNA, 71 bp, chicken (Gallus Gallus)
  misc_feature (36): n=c or t
agacttcttaagagtttctgagttgcctggaaatanctctcttgttcaaaaacgtgtctgccttcgtggcc

SEQ ID NO: 43713 - DNA, 71 bp, chicken (Gallus Gallus)
  misc_feature (36): n=a or g
cacacacccattaattgctcactgaaaaatctgggnagggtatgttgagggttgttttccaccattttact

SEQ ID NO: 43714 - DNA, 71 bp, chicken (Gallus Gallus)
  misc_feature (36): n=c or t
tatccaagaatctgctcaggtatttcagtcattccngatgaaacttgaattcttctgaacagctccctctt

SEQ ID NO: 43715 - DNA, 71 bp, chicken (Gallus Gallus)
  misc_feature (36): n=c or t
tatagaattgtatacaaattgtgtttcctggaaacntcataattgacatgtggacagttgtatcacttcaa

SEQ ID NO: 43716 - DNA, 71 bp, chicken (Gallus Gallus)
  misc_feature (36): n=a or g
tggtattactgaaagaagatgtatcatgtcagtagngatgggctacctcaaggataaggttcatctgcaac

SEQ ID NO: 43717 - DNA, 71 bp, chicken (Gallus Gallus)
  misc_feature (36): n=c or t
ctggtatggatttattgactggttgaatattgttangatacttccataattgcagttctgttgtataatag

SEQ ID NO: 43718 - DNA, 71 bp, chicken (Gallus Gallus)
  misc_feature (36): n=c or t
aacttgaactgaaatgtatgcagtaactgaaaatgnttactgctctgtacaagcagaaaatgtgaaaggga

SEQ ID NO: 43719 - DNA, 71 bp, chicken (Gallus Gallus)
  misc_feature (36): n=c or t
atgtgctacagttttatttgcaaaatacacaggtcntgtataaaacctctttttataatgtactctccaga

SEQ ID NO: 43720 - DNA, 71 bp, chicken (Gallus Gallus)
  misc_feature (36): n=c or t
actgacagcaatgttgtttacaattttagttaacanggaattaaatgggactgttcttgtggccggccata

SEQ ID NO: 43721 - DNA, 71 bp, chicken (Gallus Gallus)
  misc_feature (36): n=g or t
tgtgggattgtgtataaatgtgtagttcccctttcnttcagtggtgcctgtgtcttttccaaaaccaacta

SEQ ID NO: 43722 - DNA, 71 bp, chicken (Gallus Gallus)
  misc_feature (36): n=a or g
gtaacctactttgtttaagcaagtaatgtgaaaganccctgtgtaggagctgctccttgaccaggccctgg

SEQ ID NO: 43723 - DNA, 71 bp, chicken (Gallus Gallus)
  misc_feature (36): n=c or t
catctctaagccctcaaagaagggagcacttggatngggggtattataaatattccactatgctctgcttc

SEQ ID NO: 43724 - DNA, 71 bp, chicken (Gallus Gallus)
  misc_feature (36): n=g or t
aaacataattctagcatttaacagacgggattcctncttattagtgttagcatactctctactgttactta

SEQ ID NO: 43725 - DNA, 71 bp, chicken (Gallus Gallus)
  misc_feature (36): n=a or c
ccagttctaaattccaagctgaatttgacctaatgntttcttttcatatcatttctagacagcttctgaaa

SEQ ID NO: 43726 - DNA, 71 bp, chicken (Gallus Gallus)
  misc_feature (36): n=a or g
ccctcctgctcagttccaaataaaactcttccactnatgcctcttgcacttacagagaaagctgggaagaa

SEQ ID NO: 43727 - DNA, 71 bp, chicken (Gallus Gallus)
  misc_feature (36): n=c or t
tatggaaagccaagcctactttggatgtgaatgtanaccacatttcccagagtagagctcacaccagaatt

SEQ ID NO: 43728 - DNA, 71 bp, chicken (Gallus Gallus)
  misc_feature (36): n=a or g
aatcacatagagtattacactgtacagaatgaccanaatctaggcaaatatcagatagataaaaataggca

SEQ ID NO: 43729 - DNA, 71 bp, chicken (Gallus Gallus)
  misc_feature (36): n=a or g
aatacaaaaatacagaagtccaaaagagatgcacangtgcttccttcctaacttaaaatgaatccacatat

SEQ ID NO: 43730 - DNA, 71 bp, chicken (Gallus Gallus)
  misc_feature (36): n=g or t
tatcatcagttaaattgacatgcaatagtgatcacngcaataaacactacattcatttatacccctgaaca

SEQ ID NO: 43731 - DNA, 71 bp, chicken (Gallus Gallus)
  misc_feature (36): n=g or t
attaaactctctttgtagtgagctaccatttctgtncaaaggatttcattgatctttcatagtaatcatgc

SEQ ID NO: 43732 - DNA, 71 bp, chicken (Gallus Gallus)
  misc_feature (36): n=a or g
tgcctttacaaatgccaagtctgactaagtagtccngatcacagtaggaggtgaataccatgatcaaagtg

SEQ ID NO: 43733 - DNA, 71 bp, chicken (Gallus Gallus)
  misc_feature (36): n=c or t
tgctttctcaattcatttccagatttaaccagaaantttaaagatttgtacacatgtattccccttcccaa

SEQ ID NO: 43734 - DNA, 71 bp, chicken (Gallus Gallus)
  misc_feature (36): n=a or g
attttcagttcaaagtaataagtaattaacagagcnacaagaggatcagatatctttgcagttttggttta

SEQ ID NO: 43735 - DNA, 71 bp, chicken (Gallus Gallus)
  misc_feature (36): n=c or t
tttatagggaaaatgaatatgtccaataagaccttncccttctctgacccacagatttcctgaaacctgaa

SEQ ID NO: 43736 - DNA, 71 bp, chicken (Gallus Gallus)
  misc_feature (36): n=g or t
gaacagagagttgttgttgtacaattgcattgaggngcatggtcatctaaaactaaaggaaagggagagag

SEQ ID NO: 43737 - DNA, 71 bp, chicken (Gallus Gallus)
  misc_feature (36): n=c or t
cggtgctcagctatgtaaaagtaaacatgataaagngtatttttactgcaaacctctcagaactgtctcat

SEQ ID NO: 43738 - DNA, 71 bp, chicken (Gallus Gallus)
  misc_feature (36): n=a or g
acaaaacaatattgccaacttggagaaacggcaggnagaatttgaatgaggaatggtcaaaggtgctttgc

SEQ ID NO: 43739 - DNA, 71 bp, chicken (Gallus Gallus)
  misc_feature (36): n=a or g
ttttattagtagtctttcgtacacaacccagtaacnaacataaccaagaatgggcatgagtcgtattaaaa

SEQ ID NO: 43740 - DNA, 71 bp, chicken (Gallus Gallus)
  misc_feature (36): n=c or t
tcttcttgaacacaatagatagaacaacttcaatanacctgcaaggtgtagtagtgatttctgtgcctgtt

SEQ ID NO: 43741 - DNA, 71 bp, chicken (Gallus Gallus)
  misc_feature (36): n=a or g
ccaggtccttagatgtaatttttgcagcacctttangagactgaagttaaagaacaatagttctgtaaatg

SEQ ID NO: 43742 - DNA, 71 bp, chicken (Gallus Gallus)
  misc_feature (36): n=a or g
ataattcaatttaagatgtcaggatttaaaaatganggctactaactcagctcaatttacatttggtgctt

SEQ ID NO: 43743 - DNA, 71 bp, chicken (Gallus Gallus)
  misc_feature (36): n=c or t
atgtccctgtaacttgcctctggctatcagtggatnagtccaactctaaacagttaaagttcaagagtttg

SEQ ID NO: 43744 - DNA, 71 bp, chicken (Gallus Gallus)
  misc_feature (36): n=a or c
ggggataaggcaaatactaatgttcatctctcaagnagtacagattatatgcatcctttggatattaggga

SEQ ID NO: 43745 - DNA, 71 bp, chicken (Gallus Gallus)
  misc_feature (36): n=a or g
atctgaaattatgattcttgctcattttatcaggantaaatgaataggggaggagaagttttaaagaagta

SEQ ID NO: 43746 - DNA, 71 bp, chicken (Gallus Gallus)
  misc_feature (36): n=a or g
atgatgtcagatacgactgatttcaccctaacttcnttattcttcaagagtcgccctgtttctaaatattc

SEQ ID NO: 43747 - DNA, 71 bp, chicken (Gallus Gallus)
  misc_feature (36): n=a or g
gcattgccctctaacggaatcttgctttcagatcantttcaggatgctttgttccactttctgtgccctga

SEQ ID NO: 43748 - DNA, 71 bp, chicken (Gallus Gallus)
  misc_feature (36): n=c or t
gacaaatttcccttcattgtatgaaatgaataaccntatgccgaataatgaaattaagtattccatttgcc

SEQ ID NO: 43749 - DNA, 71 bp, chicken (Gallus Gallus)
  misc_feature (36): n=c or t
aaacaactatatttcttgatataaattcatgagaancatagcctacaagctatagaacagggcttccccat

SEQ ID NO: 43750 - DNA, 71 bp, chicken (Gallus Gallus)
  misc_feature (36): n=c or t
aatgatgttcggcaacgctggtgcatcacaaaagcngggcacatcccccggtgctgagaaggccgtggctt

SEQ ID NO: 43751 - DNA, 71 bp, chicken (Gallus Gallus)
  misc_feature (36): n=a or g
ggttgtggtgcaggttgcccacaccagcgtagtgtnaataggaaagattttttgatatgagttattaatag

SEQ ID NO: 43752 - DNA, 71 bp, chicken (Gallus Gallus)
  misc_feature (36): n=c or t
ggaagctgcaaacattgaagccagctccataagtgngatgctgtcaggagttaatgcctttttttttgttg

SEQ ID NO: 43753 - DNA, 71 bp, chicken (Gallus Gallus)
  misc_feature (36): n=a or c
ttactctgccactctgcaaaatggaataaataaganaccacaatgaaggcagctggcttcattgctcgctg

SEQ ID NO: 43754 - DNA, 71 bp, chicken (Gallus Gallus)
  misc_feature (36): n=g or t
attctaatattgtttggtatattgtaagaccacatnaaatccacttgtgagttgtagtctgccataagatc

SEQ ID NO: 43755 - DNA, 71 bp, chicken (Gallus Gallus)
  misc_feature (36): n=a or g
ggctgatctctgaatagatttattattgattgattnccctgctataaccaaaaatatgatttaaaaccttt

SEQ ID NO: 43756 - DNA, 71 bp, chicken (Gallus Gallus)
  misc_feature (36): n=a or g
ttaacctggtgagtaggttaccagatattataacanttattatactccttcctctgattgaaaaagaaatg

SEQ ID NO: 43757 - DNA, 71 bp, chicken (Gallus Gallus)
  misc_feature (36): n=a or g
ttatggcatttttatagctgttgtaaaatgtgaacnataaaattggtcaagaatcagataatactttgtat

SEQ ID NO: 43758 - DNA, 71 bp, chicken (Gallus Gallus)
  misc_feature (36): n=a or g
agcgacttcatggaggtttggtatttttattctgcngctggagagcaatttgagcttttaaatgatcattt

SEQ ID NO: 43759 - DNA, 71 bp, chicken (Gallus Gallus)
  misc_feature (36): n=g or t
aaaagaatattctggttgttttttggttactcacancaattacagtttctgtaagccttgtcacactacaa

SEQ ID NO: 43760 - DNA, 71 bp, chicken (Gallus Gallus)
  misc_feature (36): n=a or g
aatttttgacaacgttggctacctttgtctctctgncttttgtaactgcaatgtggttctaagccatgcaa

SEQ ID NO: 43761 - DNA, 71 bp, chicken (Gallus Gallus)
  misc_feature (36): n=c or t
ctgttcttattcctgtggggttttaattgtttatangttggattcagcagctgtggggaagcatggataag

SEQ ID NO: 43762 - DNA, 71 bp, chicken (Gallus Gallus)
  misc_feature (36): n=a or g
ccacagcagggttcaggtatcacagtgtgacataanaccgtttgaaaaaatgaggcaataggttacccact

SEQ ID NO: 43763 - DNA, 71 bp, chicken (Gallus Gallus)
  misc_feature (36): n=g or t
ctctacttgcaatactttcctgtatcatttagcacnggaaatcccaatgctatctcaattgcattacctct

SEQ ID NO: 43764 - DNA, 71 bp, chicken (Gallus Gallus)
  misc_feature (36): n=c or t
gttcttctagctatgatttcaagatggcaaagaacngaactaccagactgatcacattatgatcaattctt

SEQ ID NO: 43765 - DNA, 71 bp, chicken (Gallus Gallus)
  misc_feature (36): n=c or t
tttaggtcattgccaatagaatttgaaaggagccanattttaaaagcttcgtggtgatggagagccacgtg

SEQ ID NO: 43766 - DNA, 71 bp, chicken (Gallus Gallus)
  misc_feature (36): n=a or g
gacaccagctctttagactgatctactaatactacntttatattcttatctcctccccatatgaatcactg

SEQ ID NO: 43767 - DNA, 71 bp, chicken (Gallus Gallus)
  misc_feature (36): n=a or g
tgtaaatttagcaagtgaggtagactttaggaaatnccatgaacagtgtgtaggaacaactgttaggttat

SEQ ID NO: 43768 - DNA, 71 bp, chicken (Gallus Gallus)
  misc_feature (36): n=c or t
tgtaaaagcaataaactctcctcgctgctaattcanactgcgtggggtgtatacataatactgtaagagct

SEQ ID NO: 43769 - DNA, 71 bp, chicken (Gallus Gallus)
  misc_feature (36): n=a or g
taaaaatgattagatagttaaagatcaagggggacnatcttcagatgatataaatcacttcaggctcaata

SEQ ID NO: 43770 - DNA, 71 bp, chicken (Gallus Gallus)
  misc_feature (36): n=a or c
gacttgaaaaacccacaacacttagaataaatattntctctctgttcactgtactggaaatgtgtcaaaat

SEQ ID NO: 43771 - DNA, 71 bp, chicken (Gallus Gallus)
  misc_feature (36): n=c or t
tccaccaactaaaactgtttttgccttatcttcttngtcaggaaaaatgtcagatgttgttaagtgatctt

SEQ ID NO: 43772 - DNA, 71 bp, chicken (Gallus Gallus)
  misc_feature (36): n=c or t
cattctatgattgataaccatcctttcagaaaaccnaccttccaccacgagtttgtcaaatgtttgtcctt

SEQ ID NO: 43773 - DNA, 71 bp, chicken (Gallus Gallus)
  misc_feature (36): n=g or t
acagcatattgcccaggagagactgctgtgttcttnctgacatgtattgactacgctgggtctcagaagtg

SEQ ID NO: 43774 - DNA, 71 bp, chicken (Gallus Gallus)
  misc_feature (36): n=c or t
gttgtttgctgtggcatcacaaacaagtggtataantgccttatgtcctttagactttcttcaaggaaatg

SEQ ID NO: 43775 - DNA, 71 bp, chicken (Gallus Gallus)
  misc_feature (36): n=a or g
tgccacttctttatgtctctcatggtgtatgtgtgncagtatggaggtcctcctggcagtggcagatttca

SEQ ID NO: 43776 - DNA, 71 bp, chicken (Gallus Gallus)
  misc_feature (36): n=c or t
tctgctttcctctgacttctgctgatgtccattctncaaccattctggtgccaaaggggaaaatgaaaaaa

SEQ ID NO: 43777 - DNA, 71 bp, chicken (Gallus Gallus)
  misc_feature (36): n=a or g
tctctatatgatgatgtattgtgttaatctgaagcngtctgcatcacagctgttttagagcatattgctca

SEQ ID NO: 43778 - DNA, 71 bp, chicken (Gallus Gallus)
  misc_feature (36): n=a or g
tttaataaatctgagtgatattttgttatgtgttcnatttcaagtagattttcattaaattacatttttag

SEQ ID NO: 43779 - DNA, 71 bp, chicken (Gallus Gallus)
  misc_feature (36): n=c or t
ataatgcaggagataaaagatccagtgacatagttnataaacacactgtgattcttacacattgactcaat

SEQ ID NO: 43780 - DNA, 71 bp, chicken (Gallus Gallus)
  misc_feature (36): n=a or g
ctgtaagtctaagtgctgactgccagtaagatttgngcaacctatttctgacatcaattttaaaaagccac

SEQ ID NO: 43781 - DNA, 71 bp, chicken (Gallus Gallus)
  misc_feature (36): n=c or t
tttagagcagattaataaagcagaggtttgatcttncactggttcttttatgtccagttgttttaaaattt

SEQ ID NO: 43782 - DNA, 71 bp, chicken (Gallus Gallus)
  misc_feature (36): n=a or g
cgttgataaaaattcttaacttgcttttttacttcntgtacttgtcaatgctgtggatgaatagcttttgc

SEQ ID NO: 43783 - DNA, 71 bp, chicken (Gallus Gallus)
  misc_feature (36): n=c or t
tacctgaaagatcgaactcccactaatctcactaantgagactccatccagaggatcctgctgtgacagtg

SEQ ID NO: 43784 - DNA, 71 bp, chicken (Gallus Gallus)
  misc_feature (36): n=a or g
agaggagaggagttttatgatttcttctcaagtctngatttgcacgcatagctatgcatatatttccatac

SEQ ID NO: 43785 - DNA, 71 bp, chicken (Gallus Gallus)
  misc_feature (36): n=a or g
catgccatgacacttgatctcaggatcaggacagcncagatccagcccaatgcatccataacactgtcatt

SEQ ID NO: 43786 - DNA, 71 bp, chicken (Gallus Gallus)
  misc_feature (36): n=c or t
gaggagagaaggtatggctctcagtatgctgttttngataatgatttatacagcttgaaaaactgttggga

SEQ ID NO: 43787 - DNA, 71 bp, chicken (Gallus Gallus)
  misc_feature (36): n=a or g
gtgttgccatgtcctacaagagcatcagcattgtanctgcaggaaaacatttatgacattctgaaaggaag

SEQ ID NO: 43788 - DNA, 71 bp, chicken (Gallus Gallus)
  misc_feature (36): n=a or g
tgcctgacagatctggtgataaaatgctaggctggnactagaccatgtttcatttcatagtattttctgta

SEQ ID NO: 43789 - DNA, 71 bp, chicken (Gallus Gallus)
  misc_feature (36): n=g or t
cagctcagttatcagaatacgacccagggaaatttngcaagacactcacaactcttcaaactgcttattgt

SEQ ID NO: 43790 - DNA, 71 bp, chicken (Gallus Gallus)
  misc_feature (36): n=a or g
aatgcctgcattctctgttcattaatagaaaacatntactgcttggatgagggagaatagaagcaactttc

SEQ ID NO: 43791 - DNA, 71 bp, chicken (Gallus Gallus)
  misc_feature (36): n=g or t
gattcattaggcctaaatttgatgcttaatcacccncagagagtgattcagcccatctcacacccaaactg

SEQ ID NO: 43792 - DNA, 71 bp, chicken (Gallus Gallus)
  misc_feature (36): n=g or t
gcccacctggagagtggtaaagcactcaaagacatnatggtacctacagccatgggtcaagactaagccag

SEQ ID NO: 43793 - DNA, 71 bp, chicken (Gallus Gallus)
  misc_feature (36): n=c or t
tggaaaatcccttcttctcctcaagaacagtgacanacaggagtttcagcttttgaaacttgcatgctagt

SEQ ID NO: 43794 - DNA, 71 bp, chicken (Gallus Gallus)
  misc_feature (36): n=a or g
tgatgatataaagaaatgggatggagattaaaaatncataactaaagtacctgttctgatagaggtcatcg

SEQ ID NO: 43795 - DNA, 71 bp, chicken (Gallus Gallus)
  misc_feature (36): n=c or t
ggtgaaattcaaagtcatatttgcatgctgcaatanaggctactccagcttatctcatgttgtaagtgcta

SEQ ID NO: 43796 - DNA, 71 bp, chicken (Gallus Gallus)
  misc_feature (36): n=c or t
catcctgaaataccagacctcatatttttcttctantagtaaatattctgtaaaccctgggaaaaacatga

SEQ ID NO: 43797 - DNA, 71 bp, chicken (Gallus Gallus)
  misc_feature (36): n=c or t
atatgtattgctgttggccacggggtttgtactgangtctccagacctcaggattgaggcttgtcacgctt

SEQ ID NO: 43798 - DNA, 71 bp, chicken (Gallus Gallus)
  misc_feature (36): n=a or g
gagaggtgagagtgacattacagaaaacattcgccnctgtgccttcctctgatgcagaagaactaaaggaa

SEQ ID NO: 43799 - DNA, 71 bp, chicken (Gallus Gallus)
  misc_feature (36): n=c or t
gaactgtattgcaatgcaattacatggtcacacacngctttttactctgggacatctgtctcattcattgc

SEQ ID NO: 43800 - DNA, 71 bp, chicken (Gallus Gallus)
  misc_feature (36): n=a or c
ttgaaatttgtagtgtgaaaccccccttaattaccnacatatgattccaagttatttctctggtcagtgat

SEQ ID NO: 43801 - DNA, 71 bp, chicken (Gallus Gallus)
  misc_feature (36): n=a or g
cagagcagttcttgaatgtcagctaagcttttactnttattccacagtcaacatcagattgtactgccctt

SEQ ID NO: 43802 - DNA, 71 bp, chicken (Gallus Gallus)
  misc_feature (36): n=c or t
tagctttttacaccattcgaaacaaatcgattcttnacccccatggcttcaagcagaggaaaccaatagta

SEQ ID NO: 43803 - DNA, 71 bp, chicken (Gallus Gallus)
  misc_feature (36): n=c or t
aaatatcagaggtcctatttcatatgaatgcctctntgcagagtaatttgcattagcacatcctgaggtcc

SEQ ID NO: 43804 - DNA, 71 bp, chicken (Gallus Gallus)
  misc_feature (36): n=a or g
cacaaaaagcaggtattataatgtgaactcccctcntcatgacgtacaaacctgtgaagcaaatccttgca

SEQ ID NO: 43805 - DNA, 71 bp, chicken (Gallus Gallus)
  misc_feature (36): n=c or t
gatggaagatgataaaagcttcctactgaagatganttacttgttggagcaggaccactagcatcagtttg

SEQ ID NO: 43806 - DNA, 71 bp, chicken (Gallus Gallus)
  misc_feature (36): n=c or t
aaatctgatgttgtattgcaatcaaaaccaaaatgntctggggaatctaagaaaacgttccagtcaacacc

SEQ ID NO: 43807 - DNA, 71 bp, chicken (Gallus Gallus)
  misc_feature (36): n=a or g
atatccccttcaagctaaagaaaactcttatttacnaattcataaagcgcttcattttatatcaactagat

SEQ ID NO: 43808 - DNA, 71 bp, chicken (Gallus Gallus)
  misc_feature (36): n=c or t
ctttatccacagcagcgtatccagctaaaacaaaancactctgtgaaacccacacagcgttcctctacctc

SEQ ID NO: 43809 - DNA, 71 bp, chicken (Gallus Gallus)
  misc_feature (36): n=a or g
tggtactctcattaaacctcactccagctttgaaanaaaatcaatagaagactagaataaagcagttcatc

SEQ ID NO: 43810 - DNA, 71 bp, chicken (Gallus Gallus)
  misc_feature (36): n=a or g
ttgatttgggctgcacattctgaggtgatggcaacntatttatgtaaggaagtgctgtagaatccatgttc

SEQ ID NO: 43811 - DNA, 71 bp, chicken (Gallus Gallus)
  misc_feature (36): n=c or t
cagcaaaacatccagaattaacaagacccctctgcngtgcagtacgatgacagtagcacctcctcactttc

SEQ ID NO: 43812 - DNA, 71 bp, chicken (Gallus Gallus)
  misc_feature (36): n=c or t
aaggctcaggcactgcctctgcactgcctgccccanagcatgtggatgactaggtcagaattccccttcag

SEQ ID NO: 43813 - DNA, 71 bp, chicken (Gallus Gallus)
  misc_feature (36): n=c or t
tgaactaacttgaaaggaaacacattgcttgatgtngtctcttcagctgcccgcataaccctgggaaacag

SEQ ID NO: 43814 - DNA, 71 bp, chicken (Gallus Gallus)
  misc_feature (36): n=a or c
aagagatgaagcaaaaactgaaactttttactcagncagatctactctgatctcagattccttcacctaac

SEQ ID NO: 43815 - DNA, 71 bp, chicken (Gallus Gallus)
  misc_feature (36): n=a or g
cacaatgaagaactgaaactagatctcacttgcacnaaagaaattcaggaattggggtcaggaggattagt

SEQ ID NO: 43816 - DNA, 71 bp, chicken (Gallus Gallus)
  misc_feature (36): n=c or t
gtccctggtcagtattcccaaattgctacccagctngtccagatgcaccacccatgcttaatcaaatgacc

SEQ ID NO: 43817 - DNA, 71 bp, chicken (Gallus Gallus)
  misc_feature (36): n=c or t
ttgtgactatgccattgctagcttatatttcttcgngtcctgtctacactggagacagtccctcagctgta

SEQ ID NO: 43818 - DNA, 71 bp, chicken (Gallus Gallus)
  misc_feature (36): n=g or t
caagtgtatccattggccgctagatactgacactangcacatttctttgcaaaggcttaaaaaatagcata

SEQ ID NO: 43819 - DNA, 71 bp, chicken (Gallus Gallus)
  misc_feature (36): n=c or t
ggttcccaggcatggggtcatatcaaacctctaatnggtgtccttggccctgcaagagcatcccctgctcg

SEQ ID NO: 43820 - DNA, 71 bp, chicken (Gallus Gallus)
  misc_feature (36): n=c or t
agtgcagaagcagagggtgggcctgcattgctcagncccgtcctggagctctgtgtgggctgggaaatggt

SEQ ID NO: 43821 - DNA, 71 bp, chicken (Gallus Gallus)
  misc_feature (36): n=a or c
aataccgaccgtactgttcttcgctgtgctttactnaaatggcattaaaatccatcaggcatcttgtaaag

SEQ ID NO: 43822 - DNA, 71 bp, chicken (Gallus Gallus)
  misc_feature (36): n=a or g
ggttactgagctcctgcttcagctcttgtaagcacntttactccagctgagcaacccctgttttgaccatt

SEQ ID NO: 43823 - DNA, 71 bp, chicken (Gallus Gallus)
  misc_feature (36): n=a or g
ttgagacttaaagaacttgaagaggaagcccatcanattgctggagaacgattccttttgaccagcagtag

SEQ ID NO: 43824 - DNA, 71 bp, chicken (Gallus Gallus)
  misc_feature (36): n=a or g
agctcaacaaaacatgtattgtaaaatattacacanttatgatatatttgttttgatctacttaaaatagc

SEQ ID NO: 43825 - DNA, 71 bp, chicken (Gallus Gallus)
  misc_feature (36): n=a or g
ttgatggctcataggatctcctagctactggtcagnctgcgttagcacactgccttgtttcatcctgttgt

SEQ ID NO: 43826 - DNA, 71 bp, chicken (Gallus Gallus)
  misc_feature (36): n=c or t
tgcagtggatcaaaaatcagccagccagctctgttnttacgagagcaagatcttacaggaacagcttggca

SEQ ID NO: 43827 - DNA, 71 bp, chicken (Gallus Gallus)
  misc_feature (36): n=a or g
tgaactttaaagaaaatactcttgaaagcattagcnacaccacttcatacttgaacagtctttgtaaatgc

SEQ ID NO: 43828 - DNA, 71 bp, chicken (Gallus Gallus)
  misc_feature (36): n=a or g
actgtcttccaactattgcctcattttacagctgangaagttaaactagagactcgctcaaaatgagagaa

SEQ ID NO: 43829 - DNA, 71 bp, chicken (Gallus Gallus)
  misc_feature (36): n=a or g
ccttgaactgacttttgtttttatgcaatagatacngaagtggtggaaaaacaagccaaagaagaaacagt

SEQ ID NO: 43830 - DNA, 71 bp, chicken (Gallus Gallus)
  misc_feature (36): n=a or g
atagatacagaagtggtggaaaaacaagccaaagangaaacagtagtagaaaatgctactccagattatgc

SEQ ID NO: 43831 - DNA, 71 bp, chicken (Gallus Gallus)
  misc_feature (36): n=a or g
gaacactaaattctttcatggcaagctgaggtacanattgcataatacagagcctcttcgctagctctgaa

SEQ ID NO: 43832 - DNA, 71 bp, chicken (Gallus Gallus)
  misc_feature (36): n=a or c
ctgaactgagcttatgagcaagaacacaaatctgtntgtaacattttgagattaagagcttccaagcactt

SEQ ID NO: 43833 - DNA, 71 bp, chicken (Gallus Gallus)
  misc_feature (36): n=g or t
actgctttcaggtcacccactatctctatagctatnctgcatcttcttgtaagcattttagatcatgtttc

SEQ ID NO: 43834 - DNA, 71 bp, chicken (Gallus Gallus)
  misc_feature (36): n=a or g
gccttgtctgcgctattaagatttgcaaccatgtantggcatctttaactggagtggcactgactcatgct

SEQ ID NO: 43835 - DNA, 71 bp, chicken (Gallus Gallus)
  misc_feature (36): n=a or c
gagctatgtcaagaactattttgtacaagaaacttnagaaaggaatttgaaaactcctgctattttttttt

SEQ ID NO: 43836 - DNA, 71 bp, chicken (Gallus Gallus)
  misc_feature (36): n=c or t
cttgtacactatgggatcctaattcatagcaaagantctccggtgctatgattatataatgaacaaacaag

SEQ ID NO: 43837 - DNA, 71 bp, chicken (Gallus Gallus)
  misc_feature (36): n=a or g
tgcagactttgaaaattagggaaaaaactgtcaganaccgggaaactactgtgacatgaatactgttttgg

SEQ ID NO: 43838 - DNA, 71 bp, chicken (Gallus Gallus)
  misc_feature (36): n=c or t
gagttatgaatgtggtatgactgatagctgagacangctagggcatgccaatgttgctctggcaaaatgag

SEQ ID NO: 43839 - DNA, 71 bp, chicken (Gallus Gallus)
  misc_feature (36): n=a or g
ttgtacacacaggaaatgggatcctatgcatttctnacaggccactttatgcagtggtaacaattcccttc

SEQ ID NO: 43840 - DNA, 71 bp, chicken (Gallus Gallus)
  misc_feature (36): n=a or g
actcatagcccacataatctgcattataagatactnggatttttctaagcctgtttggtactgtaacaagc

SEQ ID NO: 43841 - DNA, 71 bp, chicken (Gallus Gallus)
  misc_feature (36): n=a or c
tcctctgtgtgctgattcacccttcttaacaatcantgcttgaactggggctgtatgaatcagcaggaaca

SEQ ID NO: 43842 - DNA, 71 bp, chicken (Gallus Gallus)
  misc_feature (36): n=c or t
tcctgaagtgtcatctaaggggccagtcccactcantgaatcaacagtcacaataaaaaggctgtcttcct

SEQ ID NO: 43843 - DNA, 71 bp, chicken (Gallus Gallus)
  misc_feature (36): n=g or t
gagacatcctctaaaaaattattcttcacccaagcnagaggttttcatttttctccctttcaaaaaacaga

SEQ ID NO: 43844 - DNA, 71 bp, chicken (Gallus Gallus)
  misc_feature (36): n=c or t
gagccccctgaaaagcccatgaggttactcagctcnttaaaaggggttttggagaggaaacaccttgaaac

SEQ ID NO: 43845 - DNA, 71 bp, chicken (Gallus Gallus)
  misc_feature (36): n=a or g
ctgaaagacatctctgtgaagcacgcagcaacccantgatactgacctgtgtcatcttctaattattctaa

SEQ ID NO: 43846 - DNA, 71 bp, chicken (Gallus Gallus)
  misc_feature (36): n=a or g
tgctaggcttagctctgcaggtctttctccaagtgnagcaaaattttcttaacaggatgaaggcaaattgc

SEQ ID NO: 43847 - DNA, 71 bp, chicken (Gallus Gallus)
  misc_feature (36): n=c or t
ataaaagtcttcttacaatgatcccttccagtcacnctctattcctggtcaggttctcattcctccgtatc

SEQ ID NO: 43848 - DNA, 71 bp, chicken (Gallus Gallus)
  misc_feature (36): n=c or t
taaagttctggggaatattgcccttctgcgaacacngctaattgccagcatctatcagccggagatgcctg

SEQ ID NO: 43849 - DNA, 71 bp, chicken (Gallus Gallus)
  misc_feature (36): n=a or g
aacacacacatttccgagaggagcacaagccctgcnatgaacgtgtgttgccctgcagtgaatgtactgag

SEQ ID NO: 43850 - DNA, 71 bp, chicken (Gallus Gallus)
  misc_feature (36): n=c or t
gcaagtaatgatctttcctaacaaacaatataaagntcacttatatgctagcaacctatacaggtttaacc

SEQ ID NO: 43851 - DNA, 71 bp, chicken (Gallus Gallus)
  misc_feature (36): n=c or t
cttagttggaggagagactggattaaggaaatttgnaatctgctccgtaatgagagaacaaggataaacgt

SEQ ID NO: 43852 - DNA, 71 bp, chicken (Gallus Gallus)
  misc_feature (36): n=g or t
cactgcaacctgccagcataacacttcacactgtgngggctgcatttcctttttagttccctctcagttgc

SEQ ID NO: 43853 - DNA, 71 bp, chicken (Gallus Gallus)
  misc_feature (36): n=c or t
tctacttcactgtttattaacagtgttgtgcttgtntacacaagagcagggagagtaaaagtaaagtactt

SEQ ID NO: 43854 - DNA, 71 bp, chicken (Gallus Gallus)
  misc_feature (36): n=c or t
cgtggttcagttgtaatgggtaagccttttgcagtntccttcaaatcagttgggattagtgggtgtccgtt

SEQ ID NO: 43855 - DNA, 71 bp, chicken (Gallus Gallus)
  misc_feature (36): n=g or t
atgtttaattcttctctatgcagtttgcgttgaggnaaatggtactacagtcttccttcagtactctgcac

SEQ ID NO: 43856 - DNA, 71 bp, chicken (Gallus Gallus)
  misc_feature (36): n=a or g
aaaatcattctccttttcttggatgagtaaataaangagttgctagtgaagcagagctctttcagaagctc

SEQ ID NO: 43857 - DNA, 71 bp, chicken (Gallus Gallus)
  misc_feature (36): n=a or g
acagcatgagactttccatcctgaaacccaaaggcncaacatgaggagaaatgaggcagattaggaatgaa

SEQ ID NO: 43858 - DNA, 71 bp, chicken (Gallus Gallus)
  misc_feature (36): n=c or t
ccaagttcagtggaaccagaaagcctgccatctacncatcaaatgcattccaagtgtcctacctcctcaca

SEQ ID NO: 43859 - DNA, 71 bp, chicken (Gallus Gallus)
  misc_feature (36): n=c or t
atttacattgctattattgcttatttcctctgctanccagcttcctagaggttatgcaaatcagagatgtg

SEQ ID NO: 43860 - DNA, 71 bp, chicken (Gallus Gallus)
  misc_feature (36): n=a or g
tagttcatcgacagtaattatttctataggagtagntacaaactttgacttatatgaacatcacagtaggc

SEQ ID NO: 43861 - DNA, 71 bp, chicken (Gallus Gallus)
  misc_feature (36): n=c or t
cctgtataaaagttcagaaaccactgggaccttgcngtgaatgcttgaccaccttacatttggattatctt

SEQ ID NO: 43862 - DNA, 71 bp, chicken (Gallus Gallus)
  misc_feature (36): n=g or t
ctgatgttgttctctgatgtaatataatgcagcagnatgtatattgattttaaaggacaagcatctgttta

SEQ ID NO: 43863 - DNA, 71 bp, chicken (Gallus Gallus)
  misc_feature (36): n=c or t
tgaattacagactagagccattctcagaagaatgtncttatctttaccaaagttaccttaaggagcaaagg

SEQ ID NO: 43864 - DNA, 71 bp, chicken (Gallus Gallus)
  misc_feature (36): n=c or t
atgaagtagaataggacgaagcatcattttccctgngacaggccctacaaaaacagaggtggagaaaggca

SEQ ID NO: 43865 - DNA, 71 bp, chicken (Gallus Gallus)
  misc_feature (36): n=a or g
gggtatacaaggtgtgtggatgggttgagccaaganatcctcaggggtgtaatctccttccacctcggaga

SEQ ID NO: 43866 - DNA, 71 bp, chicken (Gallus Gallus)
  misc_feature (36): n=c or t
tttactgcactgctgctttacgcacactcaaagctnctcagagctgtgggttatttgcagcccaaagtcat

SEQ ID NO: 43867 - DNA, 71 bp, chicken (Gallus Gallus)
  misc_feature (36): n=c or t
ttagtttgccagtaagggaaaacacatgttcagctntaacagaacaaactcagtgcactgtacactacttt

SEQ ID NO: 43868 - DNA, 71 bp, chicken (Gallus Gallus)
  misc_feature (36): n=c or t
agtgaaacagaagtcaatttttatcattctcccctngtggtctcccttgactgctaatagcaaggactgtg

SEQ ID NO: 43869 - DNA, 71 bp, chicken (Gallus Gallus)
  misc_feature (36): n=a or c
attaggattttatatcccgggtgctgggagataagngcctaaattaagagctggcggggtgatgggctctt

SEQ ID NO: 43870 - DNA, 71 bp, chicken (Gallus Gallus)
  misc_feature (36): n=a or g
ttcccatcgcgcctccgctgatggttttgaaaatancgtcgattttattacccttattttagtttctctta

SEQ ID NO: 43871 - DNA, 71 bp, chicken (Gallus Gallus)
  misc_feature (36): n=c or t
atcttcaggccagcatcagaaaattgcttttgattntgtgaaaagatctgactggaacacaaggagaaagg

SEQ ID NO: 43872 - DNA, 71 bp, chicken (Gallus Gallus)
  misc_feature (36): n=a or g
taatacaggaactactgaaattaaagatggaagagnttcaaagagaagagaattggcactaggtagtcgcc

SEQ ID NO: 43873 - DNA, 71 bp, chicken (Gallus Gallus)
  misc_feature (36): n=g or t
ggtgttttctggctccaaaggaaagcttcaactcanccctcagcacttgcaagcgttttgtgttttatgga

SEQ ID NO: 43874 - DNA, 71 bp, chicken (Gallus Gallus)
  misc_feature (36): n=c or t
ggtcttgtcttctgaaccagaattgaatcttgttcnagacagcagtgcaggttgccttggtctcttttagt

SEQ ID NO: 43875 - DNA, 71 bp, chicken (Gallus Gallus)
  misc_feature (36): n=a or g
tttctcagcactttgtgagtcaaacaagaaactaancagcctatgcagacatctttgggcagaccttcttc

SEQ ID NO: 43876 - DNA, 71 bp, chicken (Gallus Gallus)
  misc_feature (36): n=a or g
aatacaaatggataaaagctgattctggtatcagtntctcttctgatcacagggatgggaccaaaatataa

SEQ ID NO: 43877 - DNA, 71 bp, chicken (Gallus Gallus)
  misc_feature (36): n=c or t
ctgcaaccagactgattaatggaacagggagaagangtcagaagttgactttatgtagaacactttttatt

SEQ ID NO: 43878 - DNA, 71 bp, chicken (Gallus Gallus)
  misc_feature (36): n=a or g
tccaaaataatgtataaactagaagactgtatgctnctgcaccttgcttatttattgctggaagaaatcca

SEQ ID NO: 43879 - DNA, 71 bp, chicken (Gallus Gallus)
  misc_feature (36): n=c or t
cacatcagtgtgtgttgagtttttatgactgttttncatcaggctttctattgccagtgtttcagagctat

SEQ ID NO: 43880 - DNA, 71 bp, chicken (Gallus Gallus)
  misc_feature (36): n=a or g
aactgaaatagtatcctaacctcttgagagcaaagnataaaccaagtagaaatatatttcaacagtacttc

SEQ ID NO: 43881 - DNA, 71 bp, chicken (Gallus Gallus)
  misc_feature (36): n=c or t
gatagacaaaagtacacctcagtaataaccattccnattagccttcctagtagttgcagatacttcagagc

SEQ ID NO: 43882 - DNA, 71 bp, chicken (Gallus Gallus)
  misc_feature (36): n=a or g
caggtttagcggagagtaatcatgtaagtcaccacngaaaaacataatccattaaagatggtcttatcgtg

SEQ ID NO: 43883 - DNA, 71 bp, chicken (Gallus Gallus)
  misc_feature (36): n=g or t
tccctccagaagggttctctatgaaataacttcaanaaacttgagttgaagaactcttgagtgaaaaaaac

SEQ ID NO: 43884 - DNA, 71 bp, chicken (Gallus Gallus)
  misc_feature (36): n=c or t
ctattttgatagtctttcttccccattcagaaagcntctaagttatttccaagaaaggccttaccgatgca

SEQ ID NO: 43885 - DNA, 71 bp, chicken (Gallus Gallus)
  misc_feature (36): n=a or c
gcagcatgaaaatgtgttctgtgttagcatccagcntaggtaggcactaggaaattacctggagaagtaac

SEQ ID NO: 43886 - DNA, 71 bp, chicken (Gallus Gallus)
  misc_feature (36): n=c or t
gttccctgccagttccaactgacctgtgcattttcnttgaaagcatgtcccagcacattatagcatgacac

SEQ ID NO: 43887 - DNA, 71 bp, chicken (Gallus Gallus)
  misc_feature (36): n=a or g
aaggcaggttgtgggtgcaatcctaaatagagccangatggaaggggtggtgatatatgtggtgtgccact

SEQ ID NO: 43888 - DNA, 71 bp, chicken (Gallus Gallus)
  misc_feature (36): n=c or t
tgttctctgccttagatcaaacaagagaacgtagcntttgtaaagctgcccaggctcaaacagatcaccta

SEQ ID NO: 43889 - DNA, 71 bp, chicken (Gallus Gallus)
  misc_feature (36): n=c or t
atattggtttgcagaaagcatgacttttcatctganctttttgtgtgggaagagttttactatctcagtat

SEQ ID NO: 43890 - DNA, 71 bp, chicken (Gallus Gallus)
  misc_feature (36): n=c or t
aaacacaaaagaggagccaaagcacacacctctganctgtctgtcaatgactctcatctccttccttatct

SEQ ID NO: 43891 - DNA, 71 bp, chicken (Gallus Gallus)
  misc_feature (36): n=c or t
ccaccttagaatgggcaaactgcaacccagattgangtttttcattaggagaaagatgtttatgcagccgg

SEQ ID NO: 43892 - DNA, 71 bp, chicken (Gallus Gallus)
  misc_feature (36): n=g or t
agatgaatcgctgcagactgctatctgacagtcatntgggctgctctcatcatgttcagatctgcagatga

SEQ ID NO: 43893 - DNA, 71 bp, chicken (Gallus Gallus)
  misc_feature (36): n=a or g
gtttatgattctgtgtgcactacattgatgtccctntccttgaaatggcttttatgtccctgtcagagcgg

SEQ ID NO: 43894 - DNA, 71 bp, chicken (Gallus Gallus)
  misc_feature (36): n=g or t
aaggccatatcatgaaataattcatttcaacatcanctgcttacccttttctccagcaaaaactccagttt

SEQ ID NO: 43895 - DNA, 71 bp, chicken (Gallus Gallus)
  misc_feature (36): n=a or g
tgtgcaatggctgaatggaggaggaagtgatggggngagaaatcatagatttacagactcacagaactgtt

SEQ ID NO: 43896 - DNA, 71 bp, chicken (Gallus Gallus)
  misc_feature (36): n=a or g
gagcataatttacaaatataaaaccacatagaaacntatgtacaggagagttacattacatacaaatatgt

SEQ ID NO: 43897 - DNA, 71 bp, chicken (Gallus Gallus)
  misc_feature (36): n=a or c
caaacagactgattggaattaccttgccatccttanccagccatgcagaagcaattggagtgcaaaactga

SEQ ID NO: 43898 - DNA, 71 bp, chicken (Gallus Gallus)
  misc_feature (36): n=a or g
tcagcattggcacactgaccatgattgtgaacatcncagctttgagacagaaagaattttactattttagt

SEQ ID NO: 43899 - DNA, 71 bp, chicken (Gallus Gallus)
  misc_feature (36): n=c or t
attcatcagtgataagagtaaaaaggttacatgccncaggatgttttccttattggttacagcaagtgcag

SEQ ID NO: 43900 - DNA, 71 bp, chicken (Gallus Gallus)
  misc_feature (36): n=a or g
gcttgatcctgtcaggtattgtgaagatgtgatatngatggatgatgagaatgttctaatgtacaactggt

SEQ ID NO: 43901 - DNA, 71 bp, chicken (Gallus Gallus)
  misc_feature (36): n=c or t
aaagaaacttagaaaattatcctaaagtcagctttncctgtaggtcagataacaggagatgaactgtatcc

SEQ ID NO: 43902 - DNA, 71 bp, chicken (Gallus Gallus)
  misc_feature (36): n=c or t
aatcaatgaaaagtcagtctctggggttaataatancaggaacagatcttgtatttgaggttaactttgga

SEQ ID NO: 43903 - DNA, 71 bp, chicken (Gallus Gallus)
  misc_feature (36): n=a or c
ctaaaacttaataaaatgaattatgaagactgtgcnatgctgagggccaggaggtctataaccactctaag

SEQ ID NO: 43904 - DNA, 71 bp, chicken (Gallus Gallus)
  misc_feature (36): n=c or t
tgtattaaattgagttatgcagtaataacagacttngtattttaagtgacatttctttgcatcagctaaat

SEQ ID NO: 43905 - DNA, 71 bp, chicken (Gallus Gallus)
  misc_feature (36): n=c or t
atgtacacctaaatgtaccaaatagaaatagaaaanggaacaagttttgcattttgtggagactacaggga

SEQ ID NO: 43906 - DNA, 71 bp, chicken (Gallus Gallus)
  misc_feature (36): n=a or g
ggggcctgctttgcaagggcattggacttgatctcnttgtcttaaacatcctttgacaccatttgtttgac

SEQ ID NO: 43907 - DNA, 71 bp, chicken (Gallus Gallus)
  misc_feature (36): n=a or g
tattctttcttgcaaaaatgtaaaccagatgaatgnatggcctctgcattcctttgatcctcatttgtaga

SEQ ID NO: 43908 - DNA, 71 bp, chicken (Gallus Gallus)
  misc_feature (36): n=c or t
catgcctgggtcacttgtaaggcagccttgtcatangatgtgtatcataacaggatggggtaatattttct

SEQ ID NO: 43909 - DNA, 71 bp, chicken (Gallus Gallus)
  misc_feature (36): n=a or g
agcacataatttgtgttagtgtagaaatgtgtatcnttgtgttactctatttatctgcattctcagttgta

SEQ ID NO: 43910 - DNA, 71 bp, chicken (Gallus Gallus)
  misc_feature (36): n=a or g
acaagttccacatataacaagtattgcctcttgagncacacacacagaaaagaataatattgaaataacag

SEQ ID NO: 43911 - DNA, 71 bp, chicken (Gallus Gallus)
  misc_feature (36): n=c or t
cattgaatcagaacaggtggggagcaaaagcctaanctatttttacactgaagtctggaaaagtgatggtc

SEQ ID NO: 43912 - DNA, 71 bp, chicken (Gallus Gallus)
  misc_feature (36): n=g or t
atttcaaatgtctcaaaattcagttgttttttcacngtgtctgaaaaggctgtatgatttctgtccgtttc

SEQ ID NO: 43913 - DNA, 71 bp, chicken (Gallus Gallus)
  misc_feature (36): n=c or t
acttgattggtatcttcattcttactcctgacattnctcattttgaagaaatgtaaagacagagaaatcat

SEQ ID NO: 43914 - DNA, 71 bp, chicken (Gallus Gallus)
  misc_feature (36): n=a or g
ctaactttagtgttttctccctcctctgtaaaggtntagtattaccttcagaataaaagtcatctggcaag

SEQ ID NO: 43915 - DNA, 71 bp, chicken (Gallus Gallus)
  misc_feature (36): n=a or g
gtttcagtagctgatttgtgatcaacaaaaacaccnatgtggctatactaccctcaatgtatcttttctca

SEQ ID NO: 43916 - DNA, 71 bp, chicken (Gallus Gallus)
  misc_feature (36): n=a or g
gaacaaaatcaaaaacaacttgccacataaatttcnggaaacttttccttcaattaagccatatttagggt

SEQ ID NO: 43917 - DNA, 71 bp, chicken (Gallus Gallus)
  misc_feature (36): n=c or t
ccttcccataattctaggatgaatcatttcctcctnctccttccacatgcagctgacctgtttgatcactg

SEQ ID NO: 43918 - DNA, 71 bp, chicken (Gallus Gallus)
  misc_feature (36): n=c or t
ttagatgagattctgtttgagatgcattcaagatgngtttcacttaagataatgccgaaagcaatgaagat

SEQ ID NO: 43919 - DNA, 71 bp, chicken (Gallus Gallus)
  misc_feature (36): n=c or t
tcatggctccatctgacttctctgcatacatgaacntttaatcttaaattccaagagacttgatgtatttc

SEQ ID NO: 43920 - DNA, 71 bp, chicken (Gallus Gallus)
  misc_feature (36): n=c or t
actttttttccctttctgtataaatactggcacttntctagcttagtctgtttggaaatgatgcaattaaa

SEQ ID NO: 43921 - DNA, 71 bp, chicken (Gallus Gallus)
  misc_feature (36): n=a or c
atcactaaaagataaaacataaaacttctattaccnacatctataaacctttaagtacagctaggaaaagt

SEQ ID NO: 43922 - DNA, 71 bp, chicken (Gallus Gallus)
  misc_feature (36): n=a or g
tcgacgtgacatgaacttttcattcgactaaagacnaaaaacacatgcttacagatattactttcatgtac

SEQ ID NO: 43923 - DNA, 71 bp, chicken (Gallus Gallus)
  misc_feature (36): n=a or g
tattgagaaaggtgccatttttttatcacgtttcanagtaaatttggcattagagatgagtaattcagaca

SEQ ID NO: 43924 - DNA, 71 bp, chicken (Gallus Gallus)
  misc_feature (36): n=c or t
aatacattggcaactgattttaaagcaaacacacangtcctctttttgcactcacaacgttatgtgacttc

SEQ ID NO: 43925 - DNA, 71 bp, chicken (Gallus Gallus)
  misc_feature (36): n=a or g
tccttgacctttagctgatgagccatacatttctanagatttaagaaataggggttcttcacaatgacatc

SEQ ID NO: 43926 - DNA, 71 bp, chicken (Gallus Gallus)
  misc_feature (36): n=a or c
gagtctcatccaaagactcctactgacatcatcacncctggactaagcccaaggtttgtattataatgtct

SEQ ID NO: 43927 - DNA, 71 bp, chicken (Gallus Gallus)
  misc_feature (36): n=g or t
tgatgatgacataaaatgagagagactggacagtcncttcataagggaaaagtggatgtagctacatttag

SEQ ID NO: 43928 - DNA, 71 bp, chicken (Gallus Gallus)
  misc_feature (36): n=c or t
tcttcagaaagttcctgcaccccttcttctcagctntcctggtcaccttaagtttgttagacacagaatca

SEQ ID NO: 43929 - DNA, 71 bp, chicken (Gallus Gallus)
  misc_feature (36): n=a or g
agggagccttgaaaaatgtgtatacaatggtctganagcaggagaagattatgccactgagaaattgtcat

SEQ ID NO: 43930 - DNA, 71 bp, chicken (Gallus Gallus)
  misc_feature (36): n=a or c
gcagtatacaacattgtggcattcttcttcagagcncctcgagctgcagccatttcatccctgcagtgagg

SEQ ID NO: 43931 - DNA, 71 bp, chicken (Gallus Gallus)
  misc_feature (36): n=a or c
tatgattacgtattaggcaagagaaaatcaacaaanaagtttccgtgtttgaagtaatcggtattagccaa

SEQ ID NO: 43932 - DNA, 71 bp, chicken (Gallus Gallus)
  misc_feature (36): n=c or t
gtgccatactggtatcaatatatttatttggaatcngacatggaagttccattatttcctattttaggaca

SEQ ID NO: 43933 - DNA, 71 bp, chicken (Gallus Gallus)
  misc_feature (36): n=a or g
tgttcctaagtgccacaaatgagaatggttccctangtcacctctgcaaagttgttcaatttgaccactcc

SEQ ID NO: 43934 - DNA, 71 bp, chicken (Gallus Gallus)
  misc_feature (36): n=c or t
gttcagatgatattatgaaattatctcagtgacaangtctacataaaatactctaaaataaaagtggtcct

SEQ ID NO: 43935 - DNA, 71 bp, chicken (Gallus Gallus)
  misc_feature (36): n=a or g
taagctgggacagcacactatgtaatggtgactacntaccttcagcacgatggaaagcacaaacaaaatga

SEQ ID NO: 43936 - DNA, 71 bp, chicken (Gallus Gallus)
  misc_feature (36): n=a or c
aaaagcttaccatggcatagttgggatctttcaganctttcagagcacttttatagcccagtgcaatgtat

SEQ ID NO: 43937 - DNA, 71 bp, chicken (Gallus Gallus)
  misc_feature (36): n=c or t
aacataacgtgtcagtttcacatagaaaataggtanttcagtactggaagcagtacagcaacttcctaccg

SEQ ID NO: 43938 - DNA, 71 bp, chicken (Gallus Gallus)
  misc_feature (36): n=a or c
aaatcctttatgcctttcaggataaagtcttgggtnagataccttcctatgtcaatatctgcaaatcagta

SEQ ID NO: 43939 - DNA, 71 bp, chicken (Gallus Gallus)
  misc_feature (36): n=c or t
ccatgaattcaatttctcatgcataagtcacagagnggggttaaataaacgtttttattgcacagcaccat

SEQ ID NO: 43940 - DNA, 71 bp, chicken (Gallus Gallus)
  misc_feature (36): n=a or g
ttacaagttaacgttctgagattagggagaatagcnctgttaaatatcctccggctttcctataaatcagc

SEQ ID NO: 43941 - DNA, 71 bp, chicken (Gallus Gallus)
  misc_feature (36): n=g or t
ctgagaaataaggaaaaatgcaactacttctttctntttaatatagatttgaacccatagcaatgaaagaa

SEQ ID NO: 43942 - DNA, 71 bp, chicken (Gallus Gallus)
  misc_feature (36): n=c or t
ttgttcttcacagaccagcctgaataagaacagatnggtcttgtagcaaatatttatttctttattccatt

SEQ ID NO: 43943 - DNA, 71 bp, chicken (Gallus Gallus)
  misc_feature (36): n=c or t
gcttttctaccacgaaacacaacagtacaatttctncacccttaaagaacccttgctcattaagcagtgaa

SEQ ID NO: 43944 - DNA, 71 bp, chicken (Gallus Gallus)
  misc_feature (36): n=a or g
gtaccatcagttgagatttattggggcaatgatacntgcaagctatgtaatactgcagatcttcaataata

SEQ ID NO: 43945 - DNA, 71 bp, chicken (Gallus Gallus)
  misc_feature (36): n=a or g
acgctacttgttcagttttattgttgggttgtggtngctgaggaaggacagttcatatggctcaattatat

SEQ ID NO: 43946 - DNA, 71 bp, chicken (Gallus Gallus)
  misc_feature (36): n=c or t
aagctctcatactttcaaacagatcttttcattttncaaagttaattgataaaatttttacaggagtactg

SEQ ID NO: 43947 - DNA, 71 bp, chicken (Gallus Gallus)
  misc_feature (36): n=c or t
ccactaaatatggtcttgcagagtttttaaaagtanatgtggaggataacaaagaggaagtgctgttgatc

SEQ ID NO: 43948 - DNA, 71 bp, chicken (Gallus Gallus)
  misc_feature (36): n=a or c
tgattgtagggtgactcatgggagattttgtctgantgtgaaaaactcaatgaatggtaagatggcccatg

SEQ ID NO: 43949 - DNA, 71 bp, chicken (Gallus Gallus)
  misc_feature (36): n=a or g
cagggaaagactgttttccacagctccaggacactnctggagtgtttgttggggtgattctcatcctagct

SEQ ID NO: 43950 - DNA, 71 bp, chicken (Gallus Gallus)
  misc_feature (36): n=a or g
gaaaggtaacagatcggtcaagaaaccagcagtganttaatccagttaattaacacttgttcaatatttat

SEQ ID NO: 43951 - DNA, 71 bp, chicken (Gallus Gallus)
  misc_feature (36): n=a or g
gtgctgtcttggctgtaggggattgtgagcacatcntcttcagcatggatactctggggagagaaggggga

SEQ ID NO: 43952 - DNA, 71 bp, chicken (Gallus Gallus)
  misc_feature (36): n=g or t
acagtgagcttcatgctcataaatacttcatgaacnaaagctcaaaaaagactttcaactaccccctactc

SEQ ID NO: 43953 - DNA, 71 bp, chicken (Gallus Gallus)
  misc_feature (36): n=c or t
agcaagttcaccttccttgagagattaacagaatancgtcttcagtttcctcacagaaacaaagcttgaag

SEQ ID NO: 43954 - DNA, 71 bp, chicken (Gallus Gallus)
  misc_feature (36): n=a or c
attccactgccaatgtagagtcaacatgtaaaatgncagtagaaagatagttaatagaatcataaagtacc

SEQ ID NO: 43955 - DNA, 71 bp, chicken (Gallus Gallus)
  misc_feature (36): n=c or t
tgggaattctttgcggtttggggttttaaattcatngcagcaagcttgggagcaaagtttcaacaggaatc

SEQ ID NO: 43956 - DNA, 71 bp, chicken (Gallus Gallus)
  misc_feature (36): n=a or c
aagccaccctcttcagcaagcaagttgtggtttccnagctaaatctacatctacaccacttagaaatattg

SEQ ID NO: 43957 - DNA, 71 bp, chicken (Gallus Gallus)
  misc_feature (36): n=c or t
ccatctgctctgtttccttctccccagaccaggctnaacctgctggatgggaagctcgtggtgcagcgctc

SEQ ID NO: 43958 - DNA, 71 bp, chicken (Gallus Gallus)
  misc_feature (36): n=c or t
taaaataacccacttccttactttcatgcctctgtnctttttggagggagtaggtgagagatggtgaacag

SEQ ID NO: 43959 - DNA, 71 bp, chicken (Gallus Gallus)
  misc_feature (36): n=a or g
cagagtatctccaaaagcttaccttctgcacaaaanctattgtgccttctaataggaattttctcttccaa

SEQ ID NO: 43960 - DNA, 71 bp, chicken (Gallus Gallus)
  misc_feature (36): n=a or g
aggtgcatactagttttgaggagtttgctgaatgtngaacagctgggagctgaggatcagtgctgcctttt

SEQ ID NO: 43961 - DNA, 71 bp, chicken (Gallus Gallus)
  misc_feature (36): n=c or t
acaaagcattctgttttggattttatggtggaagantactgcaagaataccgaaaggaatcctgtagatgt

SEQ ID NO: 43962 - DNA, 71 bp, chicken (Gallus Gallus)
  misc_feature (36): n=c or t
tagattcaaaagcgaaaagcaaccattcttaaacanggctgaatttcttcttccacccactctcttttcca

SEQ ID NO: 43963 - DNA, 71 bp, chicken (Gallus Gallus)
  misc_feature (36): n=a or g
ccacatgaagatgctgtcagctgctggagtgtaganccatggtctgctccaggcagggctggtcctgagca

SEQ ID NO: 43964 - DNA, 71 bp, chicken (Gallus Gallus)
  misc_feature (36): n=c or t
tagctggctgtaagcatgggaacacttcacccggcnaatccaagtgtgtttgcaaggaattgtgctgtgca

SEQ ID NO: 43965 - DNA, 71 bp, chicken (Gallus Gallus)
  misc_feature (36): n=c or t
ttatttttgctcaataaaaatccttcacagtcaganagagataggagagtgagagatacgtatacatatag

SEQ ID NO: 43966 - DNA, 71 bp, chicken (Gallus Gallus)
  misc_feature (36): n=c or t
catcagatactcaaaattcaattaatgtaggtgttnttgatccactgactgaaagtctggttcttgtgatg

SEQ ID NO: 43967 - DNA, 71 bp, chicken (Gallus Gallus)
  misc_feature (36): n=c or t
agaaaacctggggtgagatttcctttctccttggangtggtgggtgagtccttcacggctacctcttagca

SEQ ID NO: 43968 - DNA, 71 bp, chicken (Gallus Gallus)
  misc_feature (36): n=a or g
ctgaccttcatttgatgctggcagaagctttcctgnggaacaaagcagaaatctgtcatctgaggtggccc

SEQ ID NO: 43969 - DNA, 71 bp, chicken (Gallus Gallus)
  misc_feature (36): n=c or t
aatattactctatttccacctgtttcacaagaacancatgggaccacaacagcatttatgtgccactaagt

SEQ ID NO: 43970 - DNA, 71 bp, chicken (Gallus Gallus)
  misc_feature (36): n=c or t
aacaagcacaggtcaaggctaaatctatctctagtntcagtattacatgcatactgactcagtattcaata

SEQ ID NO: 43971 - DNA, 71 bp, chicken (Gallus Gallus)
  misc_feature (36): n=c or t
gttgaaacactctccaggcaccctcatctacaaagngtgctcagatatcatttaggtgtcttaatgtacat

SEQ ID NO: 43972 - DNA, 71 bp, chicken (Gallus Gallus)
  misc_feature (36): n=c or t
aacattttgtcctgctttaacattttccaggtggcnagccaaggtcatggctggttttggcttccaccacc

SEQ ID NO: 43973 - DNA, 71 bp, chicken (Gallus Gallus)
  misc_feature (36): n=a or g
agtcttaaaagaaatacaaggatctgatgtaagtgnaagtacttgagcatggattgttctgttttataaat

SEQ ID NO: 43974 - DNA, 71 bp, chicken (Gallus Gallus)
  misc_feature (36): n=a or c
gtctctggtcaggtggcttcttggattcagaacagnaaagagcatggcttgggattactgagggcagtgcc

SEQ ID NO: 43975 - DNA, 71 bp, chicken (Gallus Gallus)
  misc_feature (36): n=c or t
gaagctgtgctatatcatgttaagataaatagctangcaaccatgcaagctggatgcttttattgttttcc

SEQ ID NO: 43976 - DNA, 71 bp, chicken (Gallus Gallus)
  misc_feature (36): n=a or g
aatgaacaaattcacattactggactgtggccatgntatcacaatataaataaacactaactccattaagc

SEQ ID NO: 43977 - DNA, 71 bp, chicken (Gallus Gallus)
  misc_feature (36): n=c or t
ttgtaaactaaatctcatattttcttagtcattacngaaagggtccctgctttccatctcctactgatttc

SEQ ID NO: 43978 - DNA, 71 bp, chicken (Gallus Gallus)
  misc_feature (36): n=c or t
atttctcctcattctccaatagtgatgccattgtcnggggatgcatatggcccaagggctacacccaaccc

SEQ ID NO: 43979 - DNA, 71 bp, chicken (Gallus Gallus)
  misc_feature (36): n=c or t
atgttgaagcttattgaataagcagattaacgatgntcaagtagctgctagggtaccacatactgatattc

SEQ ID NO: 43980 - DNA, 71 bp, chicken (Gallus Gallus)
  misc_feature (36): n=a or g
taacgttaatgactggaaatttctctgcaaaacacnagtttcctcattatgtctcattctgtaaatgacgt

SEQ ID NO: 43981 - DNA, 71 bp, chicken (Gallus Gallus)
  misc_feature (36): n=g or t
actgcaggtgaagggggtcagccatgcagaagagangtagtttatccacatttctgagttccagtaactac

SEQ ID NO: 43982 - DNA, 71 bp, chicken (Gallus Gallus)
  misc_feature (36): n=a or g
ctagtgccactaatgagaagtgtgtttgcttcacgnaatacagtgattttgtcaaatcttcacttgtccac

SEQ ID NO: 43983 - DNA, 71 bp, chicken (Gallus Gallus)
  misc_feature (36): n=c or t
cttaagggaaactctccagcttctatttgcaaatantagcaatcagctcattggcaggcatggagagatac

SEQ ID NO: 43984 - DNA, 71 bp, chicken (Gallus Gallus)
  misc_feature (36): n=a or g
atgtccctccagcctccaccagccacaaggatcaangaatccctggtgtcaccagcaagaagggatttctt

SEQ ID NO: 43985 - DNA, 71 bp, chicken (Gallus Gallus)
  misc_feature (36): n=a or g
ttgtttcagttttggaagtgttctggtgttcttccntctcctttctattctttgcatgagttaatttggga

SEQ ID NO: 43986 - DNA, 71 bp, chicken (Gallus Gallus)
  misc_feature (36): n=c or t
cccctgagtttccctcttctacatgaaagtatgttngccaagaagactgttgttggatgctcttctccaat

SEQ ID NO: 43987 - DNA, 71 bp, chicken (Gallus Gallus)
  misc_feature (36): n=c or t
cctatcacctgctgtttcgccagctgtaaataaatncccctattggtaaaatgcacattcgtggctggaga

SEQ ID NO: 43988 - DNA, 71 bp, chicken (Gallus Gallus)
  misc_feature (36): n=c or t
tgattttccccctggctgtcctgtacaaccactgcngtttcttctcttaaccacagaatctccttattaaa

SEQ ID NO: 43989 - DNA, 71 bp, chicken (Gallus Gallus)
  misc_feature (36): n=c or t
tctctacccatcacagcactgcctttgggacagcancccaaaccctttgcaaagacctctctccatgctgc

SEQ ID NO: 43990 - DNA, 71 bp, chicken (Gallus Gallus)
  misc_feature (36): n=a or g
cacgcatccaccccaacataattggtttgtgcacantgggatgtgacacagcccaaaagtgagaccttgcg

SEQ ID NO: 43991 - DNA, 71 bp, chicken (Gallus Gallus)
  misc_feature (36): n=c or t
acctcttcctttcccaaatgttacacatccttaacntgtgagctctggatgacctgcagaaacagcatgca

SEQ ID NO: 43992 - DNA, 71 bp, chicken (Gallus Gallus)
  misc_feature (36): n=a or g
ttgttctttcccagtacaatcaagaaggaagagggntttccttcatcaggaatgaggattacgttatcctt

SEQ ID NO: 43993 - DNA, 71 bp, chicken (Gallus Gallus)
  misc_feature (36): n=c or t
ttacctgccaggcaagtttaaacaatagtttgtgcncactgtagtgctctttctttgcagccaccacgcag

SEQ ID NO: 43994 - DNA, 71 bp, chicken (Gallus Gallus)
  misc_feature (36): n=g or t
actactagtttaagctgctagcataaattctgggtnaaccaggcatttttacactgcattaatgtaatgtg

SEQ ID NO: 43995 - DNA, 71 bp, chicken (Gallus Gallus)
  misc_feature (36): n=c or t
gacggtgcagttggtgcttggagaaccaagccaggngattaaaataaagagggacctgagctgtttttgtg

SEQ ID NO: 43996 - DNA, 71 bp, chicken (Gallus Gallus)
  misc_feature (36): n=g or t
taagcttcggtaaatgacttcgctgtcagtgacagnagagttgtgttagctctaatcccggtttgtttttc

SEQ ID NO: 43997 - DNA, 71 bp, chicken (Gallus Gallus)
  misc_feature (36): n=c or t
tggtatttcgagacatcccaagaatgctgccaggancacgtgaacagtgcatacatacgggctcagatcag

SEQ ID NO: 43998 - DNA, 71 bp, chicken (Gallus Gallus)
  misc_feature (36): n=a or c
gacagcagtatctgtattttgcatgtgaactaaaantgtagaggtgattcttgtgagcccattaatgccca

SEQ ID NO: 43999 - DNA, 71 bp, chicken (Gallus Gallus)
  misc_feature (36): n=c or t
gaggttggaggaattgagtgtgggtttgggacaccnatatccccaaacaatgccacgatgctaacaaagac

SEQ ID NO: 44000 - DNA, 71 bp, chicken (Gallus Gallus)
  misc_feature (36): n=a or c
tattgagggcatcctcagtgaggcaggctgtgattncctgtctgcagcacgtggctctgctatgtgggatc

SEQ ID NO: 44001 - DNA, 71 bp, chicken (Gallus Gallus)
  misc_feature (36): n=a or g
tttcttaaattactataatatagaagattgcagtangttgtatttgttgaagaaattgtgaagatctttta

SEQ ID NO: 44002 - DNA, 71 bp, chicken (Gallus Gallus)
  misc_feature (36): n=c or t
tctcatatctcagtccctactaactctgctggtcantgtggacatcctcgttagcaatccacaaatgcctt

SEQ ID NO: 44003 - DNA, 71 bp, chicken (Gallus Gallus)
  misc_feature (36): n=a or g
tgctttgttagactgtgcaggtggaaagggcctganttagatggggctgaagcccaaggaggctgtggatg

SEQ ID NO: 44004 - DNA, 71 bp, chicken (Gallus Gallus)
  misc_feature (36): n=a or g
ccctgctgcagagcggggcaaacagatgcaggatcngggcaaaagctcaatattttccctaaagaacacta

SEQ ID NO: 44005 - DNA, 71 bp, chicken (Gallus Gallus)
  misc_feature (36): n=a or g
gtacacatacctcttcggtgaccacgtgcacgtgtntttgagttcattttttatcattccattgcactttg

SEQ ID NO: 44006 - DNA, 71 bp, chicken (Gallus Gallus)
  misc_feature (36): n=g or t
tcagagagaggtgtatgtgtaccaggcatgagagcnctacatggtgtctttcttgatgacttaggtcaggc

SEQ ID NO: 44007 - DNA, 71 bp, chicken (Gallus Gallus)
  misc_feature (36): n=a or g
gcctctgaaaagtgctgctgtacatcaccattcacnctaaggtcgtcgtggtggtggtgcatgacaaatgg

SEQ ID NO: 44008 - DNA, 71 bp, chicken (Gallus Gallus)
  misc_feature (36): n=c or t
caaaaatttcttcgcagtaactattattgttaccantatcagactctgcctcaggttcctctgtactgaca

SEQ ID NO: 44009 - DNA, 71 bp, chicken (Gallus Gallus)
  misc_feature (36): n=a or g
tttgaaattacttcacttactttacaaagtggagtnatgtaaagctaccatcttgaatattttctcctgtg

SEQ ID NO: 44010 - DNA, 71 bp, chicken (Gallus Gallus)
  misc_feature (36): n=a or g
ccgttcttacagaattgattaacataacctgatgtntacttgaatatcaagtcttaaacctcaaaaatctc

SEQ ID NO: 44011 - DNA, 71 bp, chicken (Gallus Gallus)
  misc_feature (36): n=c or t
ggggactccgcccatggagagcatagggaagaatcntcccctggtcaccctggtcagcagagctctggttg

SEQ ID NO: 44012 - DNA, 71 bp, chicken (Gallus Gallus)
  misc_feature (36): n=a or c
ccgaaacaatttttcacgtcccatccgcccgtgcanacagccgcggagctccgccgcttaatgaaggcaga

SEQ ID NO: 44013 - DNA, 71 bp, chicken (Gallus Gallus)
  misc_feature (36): n=c or t
gttgaagacagcattaaccgctgaagagtggaaagntattgaagtgagaaaataggatttttttcataaac

SEQ ID NO: 44014 - DNA, 71 bp, chicken (Gallus Gallus)
  misc_feature (36): n=a or g
ccgaggagccccagctgaggacatggtcccatacantgaccatgcctctgtcttacaaagcatccctgtaa

SEQ ID NO: 44015 - DNA, 71 bp, chicken (Gallus Gallus)
  misc_feature (36): n=c or t
ttatttcatcatcatcaacacagtaataccttgcancaatggagtgctttacatttctgctctccaaagct

SEQ ID NO: 44016 - DNA, 71 bp, chicken (Gallus Gallus)
  misc_feature (36): n=c or t
taggatgtgcctttgaacacatttgttgttctctangtatatccagccagatactatgattgtgtacagta

SEQ ID NO: 44017 - DNA, 71 bp, chicken (Gallus Gallus)
  misc_feature (36): n=a or c
atagttaataaaaccatgaactactctttactgtanctaaaaaacactgtgggacaagtttccatctgcag

SEQ ID NO: 44018 - DNA, 71 bp, chicken (Gallus Gallus)
  misc_feature (36): n=a or g
gatctttttatactttaacatttcctgtgtagagangacgacggctggggaaaaacacgaagtatgacaag

SEQ ID NO: 44019 - DNA, 71 bp, chicken (Gallus Gallus)
  misc_feature (36): n=a or g
gatactcatatatccagttggagaagaaagacaganctctgttcatctcatgctgaatcagaataggtggc

SEQ ID NO: 44020 - DNA, 71 bp, chicken (Gallus Gallus)
  misc_feature (36): n=a or g
tgatgtcctggcatgcagagatagaaaacctacacnaatgtctttaggctgctgagtgtttccaaagaagg

SEQ ID NO: 44021 - DNA, 71 bp, chicken (Gallus Gallus)
  misc_feature (36): n=a or g
ttgaaaggagagctctccaactgtgtcgtattcgangtattaaaaataagtgcgatggatcttctgacaat

SEQ ID NO: 44022 - DNA, 71 bp, chicken (Gallus Gallus)
  misc_feature (36): n=c or t
ccacctgaaattttaaccaccggggaataaacagantgtgggaacctgcattactttcagccagatccctc

SEQ ID NO: 44023 - DNA, 71 bp, chicken (Gallus Gallus)
  misc_feature (36): n=c or t
aaaatgacagtgaagaaaatatacggccagttccantcgtgattttctccaatggtagacactccaagaaa

SEQ ID NO: 44024 - DNA, 71 bp, chicken (Gallus Gallus)
  misc_feature (36): n=c or t
tgcaagcatgatccagagcgtgatttcgaagggganttggacatgctgataatccagagagaaaaatgtgt

SEQ ID NO: 44025 - DNA, 71 bp, chicken (Gallus Gallus)
  misc_feature (36): n=c or t
ttctccctttttaacagaaacaacagtactgactcnctccagctttactggggaatgttttactgcaggag

SEQ ID NO: 44026 - DNA, 71 bp, chicken (Gallus Gallus)
  misc_feature (36): n=c or t
ttagcccatgccaaaataaaggtagcctgagcgtanggtagagttcaaaggctctgttctttggcttccca

SEQ ID NO: 44027 - DNA, 71 bp, chicken (Gallus Gallus)
  misc_feature (36): n=c or t
tgttgccatagcaatattactcgtgtttggaaagcngcagctttggttttctcccaggccatgctgtcaca

SEQ ID NO: 44028 - DNA, 71 bp, chicken (Gallus Gallus)
  misc_feature (36): n=a or g
ttcatctggcagttcataacctcgaggtgctttagntacttgttcatccacagcccacatgtgcatcatgg

SEQ ID NO: 44029 - DNA, 71 bp, chicken (Gallus Gallus)
  misc_feature (36): n=c or t
taggatttatcaaaatgttgttagatatttgtgtcngagcatgtcactctgttctccttttattgagtgga

SEQ ID NO: 44030 - DNA, 71 bp, chicken (Gallus Gallus)
  misc_feature (36): n=g or t
cctagtcaaagatcactctatctccaactgtttgtntttattgttatttgtgcttacagtgtcaacatata

SEQ ID NO: 44031 - DNA, 71 bp, chicken (Gallus Gallus)
  misc_feature (36): n=a or g
ccaaggcattttcagttgcttcttttcctaagcagntgtgtcggcaaagtgctcctgactcttttgttttt

SEQ ID NO: 44032 - DNA, 71 bp, chicken (Gallus Gallus)
  misc_feature (36): n=a or g
gcagatgctcttggaaaaaaataaagcctcaattcngaatgggagagactgaagtgttttagcctggggct

SEQ ID NO: 44033 - DNA, 71 bp, chicken (Gallus Gallus)
  misc_feature (36): n=a or c
tacaatcagtaaatactgatgttaattcccttcctncttacagaacattaatcacattgattgttcaggta

SEQ ID NO: 44034 - DNA, 71 bp, chicken (Gallus Gallus)
  misc_feature (36): n=a or g
caatgataatgaatgagaagtagattgtggacaatnaaatgctaggacaacagtacaatgtgatgtgtaag

SEQ ID NO: 44035 - DNA, 71 bp, chicken (Gallus Gallus)
  misc_feature (36): n=a or g
cggggaaggactgaccctcctttctgtcaaagcagnggagcaaggggcattctctggctgtatgctggcac

SEQ ID NO: 44036 - DNA, 71 bp, chicken (Gallus Gallus)
  misc_feature (36): n=c or t
gctaatacagagcatgtttttatagcaacaaattgnagtctgctaattagagacacctgaagatattctcc

SEQ ID NO: 44037 - DNA, 71 bp, chicken (Gallus Gallus)
  misc_feature (36): n=a or g
ttctgagtgggactttgagagagctgactggggccntgatcttagagttgcccacatcctatgggatacct

SEQ ID NO: 44038 - DNA, 71 bp, chicken (Gallus Gallus)
  misc_feature (36): n=c or t
agctatatgcttaagttcccctatatcatttaatgngaatatgcagaaatcaaaccagcatgaaaacagaa

SEQ ID NO: 44039 - DNA, 71 bp, chicken (Gallus Gallus)
  misc_feature (36): n=a or g
atatatgtgatcccaagggcggtcgatctcagctangatagcagatacagctctatatgtgtgattcctgt

SEQ ID NO: 44040 - DNA, 71 bp, chicken (Gallus Gallus)
  misc_feature (36): n=a or g
aatagtaactttatgaacacttgcatttttataatnagtttgaataatgtaacactgtgcaactgaagcat

SEQ ID NO: 44041 - DNA, 71 bp, chicken (Gallus Gallus)
  misc_feature (36): n=a or c
attaatctcaaaacactttacaagtttaatgaaatntaacagtttatgataagttttgaatgcttaatatt

SEQ ID NO: 44042 - DNA, 71 bp, chicken (Gallus Gallus)
  misc_feature (36): n=g or t
atagtaaataatacttgtcccaaatggcaaatattnttcttactgtaaaatttgtacttcataggttttta

SEQ ID NO: 44043 - DNA, 71 bp, chicken (Gallus Gallus)
  misc_feature (36): n=c or t
gaaggagagagctattttggacctcaaatatccctnctgttcctgacagaggcagaaaagaaaccagaaag

SEQ ID NO: 44044 - DNA, 71 bp, chicken (Gallus Gallus)
  misc_feature (36): n=a or g
gtcttattgctctttcagaaacatgctcttccatcntatggagtttgattaagcttatttcttggtgaatt

SEQ ID NO: 44045 - DNA, 71 bp, chicken (Gallus Gallus)
  misc_feature (36): n=g or t
aaaatgggaatggaataaatatgagggatagagtanaagctgaaagccgaagcattcttctaacaaggatt

SEQ ID NO: 44046 - DNA, 71 bp, chicken (Gallus Gallus)
  misc_feature (36): n=a or g
catcaaacgtttccccaatctttttgcagctcagantgttgcagcgccctgctacttttggaggaatgaaa

SEQ ID NO: 44047 - DNA, 71 bp, chicken (Gallus Gallus)
  misc_feature (36): n=g or t
actgttgcataaaaaacatgtgaagttattttctgntaaaagaacttcataccaactttatacaacaaata

SEQ ID NO: 44048 - DNA, 71 bp, chicken (Gallus Gallus)
  misc_feature (36): n=a or g
attgcatctttaacttactgacataagaaaagaagngagatgaagttttaggagttgttattatttcctgg

SEQ ID NO: 44049 - DNA, 71 bp, chicken (Gallus Gallus)
  misc_feature (36): n=a or g
gtgtagactgagtagaggagaatttgaattaagttnttgatgtagaaatgttttgaaaggagcgtgtttta

SEQ ID NO: 44050 - DNA, 71 bp, chicken (Gallus Gallus)
  misc_feature (36): n=c or t
cttaggcagctgcaaattgttgtcttgaggtttagnggagtctaaatgtcattgctctctaatgaaagctc

SEQ ID NO: 44051 - DNA, 71 bp, chicken (Gallus Gallus)
  misc_feature (36): n=a or g
gcttcatgccctgaattagtaggtaacttaagtatnccagttgcaaatataattattaatagtataattat

SEQ ID NO: 44052 - DNA, 71 bp, chicken (Gallus Gallus)
  misc_feature (36): n=a or g
tgaaccagtgctttagcagtcagctacaagtttcangcacctaatctcaatttctctcttccatgcagaca

SEQ ID NO: 44053 - DNA, 71 bp, chicken (Gallus Gallus)
  misc_feature (36): n=a or g
ggtgatcttcactaaaagctttgcagaatgatcttnatttgacatactagatttcagcctacctctacaga

SEQ ID NO: 44054 - DNA, 71 bp, chicken (Gallus Gallus)
  misc_feature (36): n=a or g
agatgcagcagcaagggtaaggatgcctatcccttngttatattgggactgtgtggtgttactctccatgc

SEQ ID NO: 44055 - DNA, 71 bp, chicken (Gallus Gallus)
  misc_feature (36): n=c or t
aaaaattgaaggtacagaataacattttgaggagtngttgaggaacaacatccttccacttaccaccaccg

SEQ ID NO: 44056 - DNA, 71 bp, chicken (Gallus Gallus)
  misc_feature (36): n=a or g
accgaggaataatttgtacaaatcctgactgcgctnttagcaagggctacagtaaacctcagatttatttt

SEQ ID NO: 44057 - DNA, 71 bp, chicken (Gallus Gallus)
  misc_feature (36): n=a or c
aatggtaattatacaatgattccccttttatattcngaaagtaatttatgcaactgggaagaaatggtacc

SEQ ID NO: 44058 - DNA, 71 bp, chicken (Gallus Gallus)
  misc_feature (36): n=a or g
actaaccaactctcccagcccttgcactttacaaangaagaaactgagacacggtgactttaatgaattaa

SEQ ID NO: 44059 - DNA, 71 bp, chicken (Gallus Gallus)
  misc_feature (36): n=a or g
cattcagaccacgatgctgtgccatttgtctgtgantgttctgtacataattaattggatgactgggacag

SEQ ID NO: 44060 - DNA, 71 bp, chicken (Gallus Gallus)
  misc_feature (36): n=a or g
caaagttccctctgctgatactctccgacaatgaangctttttacaggcttgttaaagatgttcagagaaa

SEQ ID NO: 44061 - DNA, 71 bp, chicken (Gallus Gallus)
  misc_feature (36): n=c or t
aagactatctgtaaatcagttacagcaaattacacngtagctgtattctgggatgctgaatttaaaagttt

SEQ ID NO: 44062 - DNA, 71 bp, chicken (Gallus Gallus)
  misc_feature (36): n=a or g
cataatcacaccattaaaatcacaacctctgtagancttcacagcactgtacagttaacctaaatataaca

SEQ ID NO: 44063 - DNA, 71 bp, chicken (Gallus Gallus)
  misc_feature (36): n=g or t
atttcagaatgcatttttttctgaaccacctggccntagactctttgacagctatagctcattgttaggga

SEQ ID NO: 44064 - DNA, 71 bp, chicken (Gallus Gallus)
  misc_feature (36): n=c or t
agagataagtttgtgctgaccctctttaaagatccngtgtttcctattggctatctgtagaggattagtga

SEQ ID NO: 44065 - DNA, 71 bp, chicken (Gallus Gallus)
  misc_feature (36): n=c or t
tgtatgcagaacacgctttgtgactgatgtacaacntgctcccaggttatgataagacatttcaaattgta

SEQ ID NO: 44066 - DNA, 71 bp, chicken (Gallus Gallus)
  misc_feature (36): n=c or t
atattgaattattgcttgcagtgcaacacctgacanactagaaggagtacagtgcaaattgctatcaagtg

SEQ ID NO: 44067 - DNA, 71 bp, chicken (Gallus Gallus)
  misc_feature (36): n=c or t
ctctttcacttgtttaaatactgaagcaaaattganccctccagtgacagaaatcatcacgtatttttcct

SEQ ID NO: 44068 - DNA, 71 bp, chicken (Gallus Gallus)
  misc_feature (36): n=a or c
tgatgtgtggcattaccaggcacagaactcaatganacacacaaaaaaatccttccacaaatcaaaataaa

SEQ ID NO: 44069 - DNA, 71 bp, chicken (Gallus Gallus)
  misc_feature (36): n=a or g
acattggttggattctcaataggcactctgaatatntacagaggagatcagaacaagcaggcaagctacaa

SEQ ID NO: 44070 - DNA, 71 bp, chicken (Gallus Gallus)
  misc_feature (36): n=a or g
ctgcctctgcaggcatctgttaaatgtgccagagantaatctccccatagaagaactggggcagtattaca

SEQ ID NO: 44071 - DNA, 71 bp, chicken (Gallus Gallus)
  misc_feature (36): n=a or g
aaggctttttggtctagacttgcaggggaagcaaangttctaatttgtgaaattattttagactaagtgcc

SEQ ID NO: 44072 - DNA, 71 bp, chicken (Gallus Gallus)
  misc_feature (36): n=c or t
atttacaaagatcaatattaacagacagcaattcanagcatgatgtaatctagaactgataaagaactgca

SEQ ID NO: 44073 - DNA, 71 bp, chicken (Gallus Gallus)
  misc_feature (36): n=c or t
gctcagtcaacacagccagaaatggcaccaccttcnccagactttgtacttggttgtagacccaagtgtga

SEQ ID NO: 44074 - DNA, 71 bp, chicken (Gallus Gallus)
  misc_feature (36): n=a or g
ggaactgagctgtggttactgtctttctacacaacntctcagagagaaatagaaggatataaagtcaatgg

SEQ ID NO: 44075 - DNA, 71 bp, chicken (Gallus Gallus)
  misc_feature (36): n=c or t
gaattcatttggggaatttgtgaaacagtgttaganaaaaacaccctagagcaaactagttgccattcttc

SEQ ID NO: 44076 - DNA, 71 bp, chicken (Gallus Gallus)
  misc_feature (36): n=a or g
gaatgttcagccttggagctggaaggcagatcatcntttccaagattagcaaaagctgtttgttgcactgt

SEQ ID NO: 44077 - DNA, 71 bp, chicken (Gallus Gallus)
  misc_feature (36): n=c or t
caagaccaagtatgactgcttagaagcatgctgttnccataattacccaagcaggacttgggaacatggtt

SEQ ID NO: 44078 - DNA, 71 bp, chicken (Gallus Gallus)
  misc_feature (36): n=a or g
agtttcagcactgagttctgaagttcacaggactgngtattgtaagcgtgggccaatccatcatcaaaagt

SEQ ID NO: 44079 - DNA, 71 bp, chicken (Gallus Gallus)
  misc_feature (36): n=a or g
agccaatttccagaggctgacagaaataattataanggtaaactccaaacaaaacaatggcataataccta

SEQ ID NO: 44080 - DNA, 71 bp, chicken (Gallus Gallus)
  misc_feature (36): n=a or g
gaaatcattgatggtcttgagctctgatttcatttngatttgcatgaccaacattactcctctagtcctca

SEQ ID NO: 44081 - DNA, 71 bp, chicken (Gallus Gallus)
  misc_feature (36): n=g or t
tttatttctattttttaattttgtttttacttattnctattcttgctttgttgaatgttagcctgttggct

SEQ ID NO: 44082 - DNA, 71 bp, chicken (Gallus Gallus)
  misc_feature (36): n=g or t
acgcaactgcaaatggtagtgggggcaacagtattnatactggagcaatcactgtcagaaaaactgtatgt

SEQ ID NO: 44083 - DNA, 71 bp, chicken (Gallus Gallus)
  misc_feature (36): n=g or t
agtacagaacatgaatggacatacatctggatgtanctctacagcatgtttttggcagctgtttttatctc

SEQ ID NO: 44084 - DNA, 71 bp, chicken (Gallus Gallus)
  misc_feature (36): n=a or g
ttgcaagtgaaataacaggcactgcccgtggctgtntacacatgtcgcaggaaaaaccaacacattttttc

SEQ ID NO: 44085 - DNA, 71 bp, chicken (Gallus Gallus)
  misc_feature (36): n=a or g
tatgagtgtatttatgatctgcgtgtcaatacgatncctggatttaggagaatatgtgtaaaaaacgtagc

SEQ ID NO: 44086 - DNA, 71 bp, chicken (Gallus Gallus)
  misc_feature (36): n=a or g
ccttctattcagtttctactaatttgacactctctnagggagaaaaaccaacagcaagttgctggaaaatt

SEQ ID NO: 44087 - DNA, 71 bp, chicken (Gallus Gallus)
  misc_feature (36): n=a or g
taacactgcaacacctcacttatatttcaccagaangaagataagccataggactctgtttggatgcaaaa

SEQ ID NO: 44088 - DNA, 71 bp, chicken (Gallus Gallus)
  misc_feature (36): n=a or g
cttggaagtatacaattgtgtcaaaaatacattacncaaactatttgctcttttattctgtgtcagtttcc

SEQ ID NO: 44089 - DNA, 71 bp, chicken (Gallus Gallus)
  misc_feature (36): n=c or t
tgcagagagaaattcatcttcactgtcctaagtacnttcagttgtaacaaaggactctttcaggaaagaaa

SEQ ID NO: 44090 - DNA, 71 bp, chicken (Gallus Gallus)
  misc_feature (36): n=a or g
ccctttctctcctttcctgtcgttgtgcagaagacnagtctcacacactgcagagaactggggatgtgctg

SEQ ID NO: 44091 - DNA, 71 bp, chicken (Gallus Gallus)
  misc_feature (36): n=a or g
tggggaaaaacctcagcaaaggcacagatgccacanagcatgggcactgctgtgagtgttgtcacaggtca

SEQ ID NO: 44092 - DNA, 71 bp, chicken (Gallus Gallus)
  misc_feature (36): n=a or g
agcctcctgtagtccatagactaaatcctggccctncagaagtcaatgaaaatctttacactggcctttac

SEQ ID NO: 44093 - DNA, 71 bp, chicken (Gallus Gallus)
  misc_feature (36): n=c or t
atggggaaaatcaatatccctttgtccttccattgngatacgcctatcacctgccctggaagtggggacgt

SEQ ID NO: 44094 - DNA, 71 bp, chicken (Gallus Gallus)
  misc_feature (36): n=a or g
tgaaaaacgggtacttctgttttccagttgaagaanatctattgagaaggatgtatctttataattgtcag

SEQ ID NO: 44095 - DNA, 71 bp, chicken (Gallus Gallus)
  misc_feature (36): n=c or t
tttgaatgatcacactgcagccttttccccccaccnttatgattatgaatgagaaagtgaagaaagtggat

SEQ ID NO: 44096 - DNA, 71 bp, chicken (Gallus Gallus)
  misc_feature (36): n=c or t
gaaaagttaatcaagaagtaacagtgccacactaanattgtccttgttctcagtggttatatatgtaacat

SEQ ID NO: 44097 - DNA, 71 bp, chicken (Gallus Gallus)
  misc_feature (36): n=g or t
gcagaagggaaggaagttcttaccacatttggaaantctgccagtcatcaactccatacagttagtggtgt

SEQ ID NO: 44098 - DNA, 71 bp, chicken (Gallus Gallus)
  misc_feature (36): n=a or c
tatataatgtcaagatacaggcttttcctgaccaangcattcaagctgatagcacaaacaacagcaggaga

SEQ ID NO: 44099 - DNA, 71 bp, chicken (Gallus Gallus)
  misc_feature (36): n=g or t
tctccagtattttactctttattctgcttaggaatngtaacagtctggttatccttgatttctccttcctt

SEQ ID NO: 44100 - DNA, 71 bp, chicken (Gallus Gallus)
  misc_feature (36): n=a or c
cactgagcaaactctggcctggtagaaacacaaaancagaaacctatcctagtatgatgtaaagtcctgtc

SEQ ID NO: 44101 - DNA, 71 bp, chicken (Gallus Gallus)
  misc_feature (36): n=c or t
caccacagtggattattttctgttgttaagagttangtctgcagttatggaatggctttgtaactgaagca

SEQ ID NO: 44102 - DNA, 71 bp, chicken (Gallus Gallus)
  misc_feature (36): n=a or g
agcaaagagatgctgttctgaagtgagccaggctcntgagagggctgggcacatgaactgcaactcgggta

SEQ ID NO: 44103 - DNA, 71 bp, chicken (Gallus Gallus)
  misc_feature (36): n=c or t
taagccctttatgaagaaaggaccaaagcaacattngtgtaatgcctaaggaaaacctgaaatgaggataa

SEQ ID NO: 44104 - DNA, 71 bp, chicken (Gallus Gallus)
  misc_feature (36): n=c or t
cccagtgcagcctgtagattgttctaagctgcatanacagctatttcctttcagcaacaatttgtcctatt

SEQ ID NO: 44105 - DNA, 71 bp, chicken (Gallus Gallus)
  misc_feature (36): n=a or g
aacacgccaagtctaactcctcagaggactgaggcnatgaaatgactcatgtttgaatgtgcactcctggt

SEQ ID NO: 44106 - DNA, 71 bp, chicken (Gallus Gallus)
  misc_feature (36): n=a or g
ttgcaatgcaaccgattaacctcccagtgattttcntactaaagatcaacaatttatgtaaatattacatc

SEQ ID NO: 44107 - DNA, 71 bp, chicken (Gallus Gallus)
  misc_feature (36): n=a or c
aggaagggcatgatcaatgtggcagttcctgaaaantttcctggggagcagtaaagaaaaatgaatttact

SEQ ID NO: 44108 - DNA, 71 bp, chicken (Gallus Gallus)
  misc_feature (36): n=c or t
cctctcattcatccccctcaagttaatcatatgtgnttcaatttccctcttaagctgtgatgcaagctcct

SEQ ID NO: 44109 - DNA, 71 bp, chicken (Gallus Gallus)
  misc_feature (36): n=g or t
aaaaattattttgttctagtggagaatttatgttgnctggaaggtttaagctttttacattctctttgcta

SEQ ID NO: 44110 - DNA, 71 bp, chicken (Gallus Gallus)
  misc_feature (36): n=g or t
atcagtgcagtgactactattctaggatcctgctcncagcagaatggcttctccagcataaattactttct

SEQ ID NO: 44111 - DNA, 71 bp, chicken (Gallus Gallus)
  misc_feature (36): n=a or c
ccacaatatggtccaaggcactccgcaagcagttanttcacatctggcagactgccacgcttcagattcca

SEQ ID NO: 44112 - DNA, 71 bp, chicken (Gallus Gallus)
  misc_feature (36): n=c or t
gtgtttattacgcatgattctgaagaaagtagatancacagtgacaaagtgcacagaatgacttttaaact

SEQ ID NO: 44113 - DNA, 71 bp, chicken (Gallus Gallus)
  misc_feature (36): n=a or g
tgtattttaaccaagttattaaggtggcactggacnaacccttattacacatctatgaatctacagtggcg

SEQ ID NO: 44114 - DNA, 71 bp, chicken (Gallus Gallus)
  misc_feature (36): n=c or t
cactaatcctcagtggactttcttcttttgcacacngcattctaccagtgtggtgctcactgggaccaaat

SEQ ID NO: 44115 - DNA, 71 bp, chicken (Gallus Gallus)
  misc_feature (36): n=c or t
aggattgacctttcccagttcaatatatgcactcanttcactgacccctcttggctcctaccaagcaaatg

SEQ ID NO: 44116 - DNA, 71 bp, chicken (Gallus Gallus)
  misc_feature (36): n=a or g
ggacaggactcattcagcagtgctttagctatacanatctaattccagtgtaaaaaacactcttctcagtt

SEQ ID NO: 44117 - DNA, 71 bp, chicken (Gallus Gallus)
  misc_feature (36): n=c or t
attggtggctgaacaccttatataacctgactccangcctcaaggtagtttcagcagaagacacaaaattc

SEQ ID NO: 44118 - DNA, 71 bp, chicken (Gallus Gallus)
  misc_feature (36): n=c or t
tgttgaaagtcttttacagtatgtcttgcatcatantattcagggtgagaagctctattctgacttctagc

SEQ ID NO: 44119 - DNA, 71 bp, chicken (Gallus Gallus)
  misc_feature (36): n=a or g
aaaagactttttttattgttcatcggggcatatttnctgcatcatggccttatacttcatttcatgacctg

SEQ ID NO: 44120 - DNA, 71 bp, chicken (Gallus Gallus)
  misc_feature (36): n=a or g
gtaaaacaagaagggagaattgatgatggaaaaggncaagacccactgcccaccccatgctgcaatctgca

SEQ ID NO: 44121 - DNA, 71 bp, chicken (Gallus Gallus)
  misc_feature (36): n=a or g
aaataggactgacatacaaatgaaatacgaagacantacagacacaggctgcagtccctgcagactcccag

SEQ ID NO: 44122 - DNA, 71 bp, chicken (Gallus Gallus)
  misc_feature (36): n=a or g
ttttcagactaactgacattttgggcaactgagtantacaagtgacacaaacatatttgttcaagaaccat

SEQ ID NO: 44123 - DNA, 71 bp, chicken (Gallus Gallus)
  misc_feature (36): n=a or c
gtttatacaggcaagagggctgccctccagctcagnacagatgaggaatttcctgcaagaagatcccacct

SEQ ID NO: 44124 - DNA, 71 bp, chicken (Gallus Gallus)
  misc_feature (36): n=a or g
cccaaagcaaaaaataaggggtgcatgttaacatcngggtcctttcggaagcagttgggtttcgcgtggtg

SEQ ID NO: 44125 - DNA, 71 bp, chicken (Gallus Gallus)
  misc_feature (36): n=a or g
agggcttacacgaacttcctcccacagccccaaagngcattcacctgagcccagaaggagcaaggagaagc

SEQ ID NO: 44126 - DNA, 71 bp, chicken (Gallus Gallus)
  misc_feature (36): n=a or g
agtagaataaaactattagttctagtgaggttcccnactaaatatctatgatgttaatggcaatgcatatt

SEQ ID NO: 44127 - DNA, 71 bp, chicken (Gallus Gallus)
  misc_feature (36): n=a or g
cgtgaacttgtcatgactagatagagaaaacatcangaggcttacccagtatggcaaaggaggtctgtcag

SEQ ID NO: 44128 - DNA, 71 bp, chicken (Gallus Gallus)
  misc_feature (36): n=a or g
cttttatatccagggccttcccaagctccaagcttntgctttatctccttttgtgaatttctgcatttgta

SEQ ID NO: 44129 - DNA, 71 bp, chicken (Gallus Gallus)
  misc_feature (36): n=g or t
ttggcactgctcccaacgaattattctaagtcatanttacctatatcatagaaatgcctagctcctaccat

SEQ ID NO: 44130 - DNA, 71 bp, chicken (Gallus Gallus)
  misc_feature (36): n=a or g
tagagtttgttctatttattgcttatacatcttaangaaaccttgataccaccttgacttcctgtcctgga

SEQ ID NO: 44131 - DNA, 71 bp, chicken (Gallus Gallus)
  misc_feature (36): n=a or g
gtggcacgggaggaaaaatcactatttagtcaatgnaggaaaatgcaagacatcatgcattttaagctagt

SEQ ID NO: 44132 - DNA, 71 bp, chicken (Gallus Gallus)
  misc_feature (36): n=c or t
taaagaatctgagggtgaagaaggctgtaagaatanaattgttacacttaagaaataaacagtcctgtgat

SEQ ID NO: 44133 - DNA, 71 bp, chicken (Gallus Gallus)
  misc_feature (36): n=a or c
ttctggaagacaatagcatttctgagtcacgttttntatcagcccagcgcagagaggtacccagtgattgt

SEQ ID NO: 44134 - DNA, 71 bp, chicken (Gallus Gallus)
  misc_feature (36): n=g or t
tccgaagcctttgttatcattagctttcaaaaacanttgtcctgaagcttttgaatatccaaaatgaagtt

SEQ ID NO: 44135 - DNA, 71 bp, chicken (Gallus Gallus)
  misc_feature (36): n=a or g
gaggcacaagctgctgagtgctttctctgcaaggcnatgataatgaggagacagctatccctcctcccatg

SEQ ID NO: 44136 - DNA, 71 bp, chicken (Gallus Gallus)
  misc_feature (36): n=c or t
taatcatttgagctggcaccatcagttctgcagatnagatgggtagttatcttttacctctgagtgacctg

SEQ ID NO: 44137 - DNA, 71 bp, chicken (Gallus Gallus)
  misc_feature (36): n=a or c
cttagaaatgcttgtgatcctcatttattgtagaantggatttcaggtcttgctacagcagagaggtgtgc

SEQ ID NO: 44138 - DNA, 71 bp, chicken (Gallus Gallus)
  misc_feature (36): n=c or t
ttctaacaagagatgtgaattggagttgactgctcnacatgaaaggctctctattccaattactcactgct

SEQ ID NO: 44139 - DNA, 71 bp, chicken (Gallus Gallus)
  misc_feature (36): n=a or g
aacttttcaatttgaagttgaagcaaaacactaagnacaaagaactaaaaatgtttggagaacacatctaa

SEQ ID NO: 44140 - DNA, 71 bp, chicken (Gallus Gallus)
  misc_feature (36): n=c or t
ttgggggaaaaattatatattatgacaaggcaatcngtagtataacaattactgttgttttcatatagtta

SEQ ID NO: 44141 - DNA, 71 bp, chicken (Gallus Gallus)
  misc_feature (36): n=a or g
aaatgtgaataataggaattcctcagtttaccaagntatacacaaagacattgaaagttgatgatattttt

SEQ ID NO: 44142 - DNA, 71 bp, chicken (Gallus Gallus)
  misc_feature (36): n=c or t
agaaaaattaatgtaatggaacaattttgaaaggcncataaataatgagctgagaaccaaaagcttgaaac

SEQ ID NO: 44143 - DNA, 71 bp, chicken (Gallus Gallus)
  misc_feature (36): n=a or g
gaccagaggacaacaggacacagctgcagaaaaagnaagactgggtgttcttattctccattagtgccttt

SEQ ID NO: 44144 - DNA, 71 bp, chicken (Gallus Gallus)
  misc_feature (36): n=a or g
tcaacccagtttcagaacgatggggttgaaagaaanaggagactacacgcacctttgtatcaaactcaaag

SEQ ID NO: 44145 - DNA, 71 bp, chicken (Gallus Gallus)
  misc_feature (36): n=a or g
tgcagttatgtacattcaggtgcaatttgctcacangctgggtatcaccgagttgtaatcttgttttattc

SEQ ID NO: 44146 - DNA, 71 bp, chicken (Gallus Gallus)
  misc_feature (36): n=a or g
gttgaagcaggtacttggagctaagcatgtgcttanctcacattgaattccaaattagtcatacttaaggg

SEQ ID NO: 44147 - DNA, 71 bp, chicken (Gallus Gallus)
  misc_feature (36): n=c or t
gagaaccttaatgatttgcgtttaggtttgagttangggatttttataagacctgaactctccctcagata

SEQ ID NO: 44148 - DNA, 71 bp, chicken (Gallus Gallus)
  misc_feature (36): n=a or c
ccactagcctccttgctgtgttttctaagcagcagngattgcagagcatttgagcatagaagcagatgaga

SEQ ID NO: 44149 - DNA, 71 bp, chicken (Gallus Gallus)
  misc_feature (36): n=a or g
ctcaagaagatacaatgacaaggcaaaaaggaggtnggagaacacaaagcacaaaaggattttgcaagaga

SEQ ID NO: 44150 - DNA, 71 bp, chicken (Gallus Gallus)
  misc_feature (36): n=c or t
taaaccaactctatttacaaaattcacttttcttanttattaatgccaatgtctatgggtctgcatctaag

SEQ ID NO: 44151 - DNA, 71 bp, chicken (Gallus Gallus)
  misc_feature (36): n=a or g
cagccaacggttatactgacacggcaaaaggaagcngatctgctgacaaatacctcacgttactttaggag

SEQ ID NO: 44152 - DNA, 71 bp, chicken (Gallus Gallus)
  misc_feature (36): n=a or g
tggtatatctgtaagagattagattgctattgtatnctgtaaaacattggcatagattatgaacttgttta

SEQ ID NO: 44153 - DNA, 71 bp, chicken (Gallus Gallus)
  misc_feature (36): n=a or c
cttttgtttattgacaataagttatgcacgctatangtaattgtcttgatagtttttctgaaaccaatttg

SEQ ID NO: 44154 - DNA, 71 bp, chicken (Gallus Gallus)
  misc_feature (36): n=g or t
gttagcatggtagttcaatgcattgtacactaagtncagcatgtactctccacctgtggtcataagatctt

SEQ ID NO: 44155 - DNA, 71 bp, chicken (Gallus Gallus)
  misc_feature (36): n=c or t
aaaaacaaaatcattatgttcacataaacttttganccagcagtggaaagttgttcatctactaaatacac

SEQ ID NO: 44156 - DNA, 71 bp, chicken (Gallus Gallus)
  misc_feature (36): n=c or t
tcctaaaagttactgaaagatgaggcatcatcatanagagaagcacaaaagtcatctcagtggcaacaatg

SEQ ID NO: 44157 - DNA, 71 bp, chicken (Gallus Gallus)
  misc_feature (36): n=a or g
tatcaaaattatgttattgaagtgagctcttctctntttcttgttaatactatcacatttctagctcaaga

SEQ ID NO: 44158 - DNA, 71 bp, chicken (Gallus Gallus)
  misc_feature (36): n=a or g
gaaaaaataaagttctcaaagctctaagtcatcacnttgaagattttatcaattttgtctcatcacttgtc

SEQ ID NO: 44159 - DNA, 71 bp, chicken (Gallus Gallus)
  misc_feature (36): n=a or g
accactatactaacctaatcatactccaccatgatnaaaagctaagaggcaattcagtgaggagaatgaca

SEQ ID NO: 44160 - DNA, 71 bp, chicken (Gallus Gallus)
  misc_feature (36): n=c or t
atactgatacactttttcagtaagcacaataatatnacatattacacaacactttatttgagccccactga

SEQ ID NO: 44161 - DNA, 71 bp, chicken (Gallus Gallus)
  misc_feature (36): n=c or t
tttgtttcattaaaaagttcagagtttaggatgccntccctagtgccctaagccaattcaagcttgtaatt

SEQ ID NO: 44162 - DNA, 71 bp, chicken (Gallus Gallus)
  misc_feature (36): n=a or g
gcacaatgagtacaactcagtgatgttctgtcttcnaattaccagccagataatacatactatccagcttg

SEQ ID NO: 44163 - DNA, 71 bp, chicken (Gallus Gallus)
  misc_feature (36): n=c or t
tatattttttccaagcctaaacaaacaagcacaacnagcctaggagacagaaggggtagacaaacccccag

SEQ ID NO: 44164 - DNA, 71 bp, chicken (Gallus Gallus)
  misc_feature (36): n=c or t
accacaaagctagaattaactggatcttattttacntcatgaattattgaattttctatccatctcaaaca

SEQ ID NO: 44165 - DNA, 71 bp, chicken (Gallus Gallus)
  misc_feature (36): n=a or g
agctacagaacaccaagtattatcatttcactagantaactgcaaaacaccacattagagagtgacttgaa

SEQ ID NO: 44166 - DNA, 71 bp, chicken (Gallus Gallus)
  misc_feature (36): n=a or g
atgatcttaacaccttcaacagcacagtttagagcnaaaacttaatgtctatcatcccatctattactgtt

SEQ ID NO: 44167 - DNA, 71 bp, chicken (Gallus Gallus)
  misc_feature (36): n=c or t
aaggtgctaatttctgaatagaacgaaggacatccnaatatgtgttctcacagctaatgctgggctacacg

SEQ ID NO: 44168 - DNA, 71 bp, chicken (Gallus Gallus)
  misc_feature (36): n=a or g
tcttggtgacagcatgttagaaatatttcggagaanctgcttgtataaaatcacagtgtatcaggagcatt

SEQ ID NO: 44169 - DNA, 71 bp, chicken (Gallus Gallus)
  misc_feature (36): n=c or t
taatactcagtaagttatgtatgatactcacttgcncaaccagctcacatgatgagctgagtaagtactaa

SEQ ID NO: 44170 - DNA, 71 bp, chicken (Gallus Gallus)
  misc_feature (36): n=c or t
ccaaaaagcaaatgcagtgaatgctggtggtagtgntatctttttatgcaggtccactttagcactgggga

SEQ ID NO: 44171 - DNA, 71 bp, chicken (Gallus Gallus)
  misc_feature (36): n=a or c
attttcattgaaatccttaaagaaagcccttttaangtgccaatttaaaaaatctataaatttggggtgtt

SEQ ID NO: 44172 - DNA, 71 bp, chicken (Gallus Gallus)
  misc_feature (36): n=a or g
tctgctcttgccccagcatttcccactatttacccntctacacacacaagaactacttcagtctatttttc

SEQ ID NO: 44173 - DNA, 71 bp, chicken (Gallus Gallus)
  misc_feature (36): n=c or t
ctaacactgctttttacattctctatgactctagantgcagtcggtgattgtacactacttcttcaaatgg

SEQ ID NO: 44174 - DNA, 71 bp, chicken (Gallus Gallus)
  misc_feature (36): n=c or t
tcctgttgtattgctgcctagaattgacgagatgcngagctggcagaccttttgggtgagcttggagggct

SEQ ID NO: 44175 - DNA, 71 bp, chicken (Gallus Gallus)
  misc_feature (36): n=c or t
agtcatgctaatccctgggagggaacctgctaatgntgggaggagtaccatgggggagatgggtgggaaca

SEQ ID NO: 44176 - DNA, 71 bp, chicken (Gallus Gallus)
  misc_feature (36): n=a or c
tgagaatgaaggactgaatgtcttcaagtgttcttnagaggggcagactttggatctggtgtatttctgaa

SEQ ID NO: 44177 - DNA, 71 bp, chicken (Gallus Gallus)
  misc_feature (36): n=c or t
cttacaaggaattcttgtctttactttcctaccagngccatcttcaacaccctttcaccaaggtatatctg

SEQ ID NO: 44178 - DNA, 71 bp, chicken (Gallus Gallus)
  misc_feature (36): n=c or t
agcctccctccctctcctactgaagacagagttggntatgaaattgctgtaaactggtatggggctttttt

SEQ ID NO: 44179 - DNA, 71 bp, chicken (Gallus Gallus)
  misc_feature (36): n=a or g
attactttattttatacttggaatctgagacttcantgggcataaggtaataccaggaactagcaggagct

SEQ ID NO: 44180 - DNA, 71 bp, chicken (Gallus Gallus)
  misc_feature (36): n=c or t
aattcttcctctttgcttcatgccttcaagaaaagnttttattaagaatttccacacacagcagaaaaaat

SEQ ID NO: 44181 - DNA, 71 bp, chicken (Gallus Gallus)
  misc_feature (36): n=a or c
gtagagcatactttgcattccctgtgcctcaggttnctccacagtgtttcacattcttcacctgacctgca

SEQ ID NO: 44182 - DNA, 71 bp, chicken (Gallus Gallus)
  misc_feature (36): n=g or t
tttttgattgccttccagatttctctacactttcgngcctttgagctgaggacaaccagaggctgtcaggg

SEQ ID NO: 44183 - DNA, 71 bp, chicken (Gallus Gallus)
  misc_feature (36): n=a or c
cttaaagaaatcctagtacatgaaggagtttggagngcttccaagtaaaagtgcccacttactggtttatt

SEQ ID NO: 44184 - DNA, 71 bp, chicken (Gallus Gallus)
  misc_feature (36): n=g or t
tctccacactacatacagtgcaacagcaaaaaacgntcattctcaagtacacgaccatctactgtgagaat

SEQ ID NO: 44185 - DNA, 71 bp, chicken (Gallus Gallus)
  misc_feature (36): n=a or g
ctgaaatgtgtattattgtcacatctgaatcgctcnctttgattcctgtattttctagtatgtgcagttta

SEQ ID NO: 44186 - DNA, 71 bp, chicken (Gallus Gallus)
  misc_feature (36): n=g or t
aaggttagttttccattacgtttcctaaagacagtnaccaagtttgattacggctcagagacttagaaagg

SEQ ID NO: 44187 - DNA, 71 bp, chicken (Gallus Gallus)
  misc_feature (36): n=c or t
cctctgtgctcaggacaggttatttttcacatttangtgggcatgataaggagtcccagaaggccaatttt

SEQ ID NO: 44188 - DNA, 71 bp, chicken (Gallus Gallus)
  misc_feature (36): n=a or c
ttttttgttactgacttacctctgcagcccaaacanacattccaaggcatacatgcctccctcgcctctcc

SEQ ID NO: 44189 - DNA, 71 bp, chicken (Gallus Gallus)
  misc_feature (36): n=a or g
acctttcaaagggcagaaaaacacacgtgctgttancttgaaggcgatttgtacaaaatcttctcagacaa

SEQ ID NO: 44190 - DNA, 71 bp, chicken (Gallus Gallus)
  misc_feature (36): n=c or t
taataatattttaacaatctgtggtaaagatacacnaacagcacactctgacacaaaactgttcaccgtca

SEQ ID NO: 44191 - DNA, 71 bp, chicken (Gallus Gallus)
  misc_feature (36): n=a or g
agcgtaaacacacctttatctgatccaacctgcatncagatcacttggtcgtaattctgtgatttaccaat

SEQ ID NO: 44192 - DNA, 71 bp, chicken (Gallus Gallus)
  misc_feature (36): n=a or g
agactgatagttctgtattgaagagacattcatcangcaggtctctttcacttccccttccaagtctgaga

SEQ ID NO: 44193 - DNA, 71 bp, chicken (Gallus Gallus)
  misc_feature (36): n=c or t
atggactgcatgctcatttgcagttggaacacatcntccaatttagttcctctgaaaggaacccaggtcac

SEQ ID NO: 44194 - DNA, 71 bp, chicken (Gallus Gallus)
  misc_feature (36): n=a or g
ccaaggacttgatctggcagaggaacagaagagccntgtcaggagatccaagtggaataattacatgaaat

SEQ ID NO: 44195 - DNA, 71 bp, chicken (Gallus Gallus)
  misc_feature (36): n=a or c
actagcttccaaaaatcttttcatcctctctgactnttttagtatttttgctgtcctgacttgtaactgtt

SEQ ID NO: 44196 - DNA, 71 bp, chicken (Gallus Gallus)
  misc_feature (36): n=c or t
ggggaccttgtaattaaaggcagtggaacatttgtnagttagtgggaggtaaatatgcaaaagcatacagt

SEQ ID NO: 44197 - DNA, 71 bp, chicken (Gallus Gallus)
  misc_feature (36): n=a or g
gtaatcgttcttattctgtgaagaggacaagtattntcctggtgctacttgtaagtcaccatatctagttc

SEQ ID NO: 44198 - DNA, 71 bp, chicken (Gallus Gallus)
  misc_feature (36): n=c or t
atccctctctgaagagcctagtttccatttaaaatncagcaagtcaaaagtcatgtgggtagaagatgact

SEQ ID NO: 44199 - DNA, 71 bp, chicken (Gallus Gallus)
  misc_feature (36): n=c or t
gagaagatgtattatattactaaggttgcatcatangtatctcatgtagtgcataatataatgctgtatgt

SEQ ID NO: 44200 - DNA, 71 bp, chicken (Gallus Gallus)
  misc_feature (36): n=g or t
gtttgcagatttctttgccctaagtcacactgtgancaggacagtaagtagtttgagaaccaactcatgga

SEQ ID NO: 44201 - DNA, 71 bp, chicken (Gallus Gallus)
  misc_feature (36): n=c or t
tctgtacttctgctttgttgctgagctgtaacccancctgactattcagaatgtgtggaaaactgtcttta

SEQ ID NO: 44202 - DNA, 71 bp, chicken (Gallus Gallus)
  misc_feature (36): n=c or t
tgctttctgttacacttaacattttttggggttacncatcatgtctttaatgatgagggaagaattctgag

SEQ ID NO: 44203 - DNA, 71 bp, chicken (Gallus Gallus)
  misc_feature (36): n=c or t
ggtaggtgtggtaggaagagccaccaaactcttcantgggctgatgaagaaaactgaggccagggagccta

SEQ ID NO: 44204 - DNA, 71 bp, chicken (Gallus Gallus)
  misc_feature (36): n=a or g
caagtagagggtgagctgaaggatagtttttatagntatcctacattaatatttcatgttcagcacagcac

SEQ ID NO: 44205 - DNA, 71 bp, chicken (Gallus Gallus)
  misc_feature (36): n=c or t
gtaaaaatgaatgatacaggcaattattttctcctnctagtctctttatgttattatcatggtgttctaag

SEQ ID NO: 44206 - DNA, 71 bp, chicken (Gallus Gallus)
  misc_feature (36): n=a or g
gcttgcaagttaattgcactgctgtggttaaatagntatattgagtagagaacttggctcttcactttgca

SEQ ID NO: 44207 - DNA, 71 bp, chicken (Gallus Gallus)
  misc_feature (36): n=a or g
agctgaaatccttttttgtgtggtgtcattcctacngagtaggaatcgagggaagtgaatttacaagaagt

SEQ ID NO: 44208 - DNA, 71 bp, chicken (Gallus Gallus)
  misc_feature (36): n=a or c
ctgttttgctgcagaaatgcatggaaatgaagaatnccatccttgcaaaacagaaggagatgcacagctcc

SEQ ID NO: 44209 - DNA, 71 bp, chicken (Gallus Gallus)
  misc_feature (36): n=c or t
agctgaaactgaaaggcaacctaaaaatttccctangagcagatgacaaaaagatcagatgaaattcagga

SEQ ID NO: 44210 - DNA, 71 bp, chicken (Gallus Gallus)
  misc_feature (36): n=c or t
tttatgaatggcgtcgtcccctccagaataaccccnttgtcccccaatgagcaggtcagactggaagctga

SEQ ID NO: 44211 - DNA, 71 bp, chicken (Gallus Gallus)
  misc_feature (36): n=a or g
tttgtgtcatttgctgctcttatttccagtcttgcngtgaaagtgccccagagtctctttgctccttcacc

SEQ ID NO: 44212 - DNA, 71 bp, chicken (Gallus Gallus)
  misc_feature (36): n=a or g
attactgaattttcaccataacaatttaaaaagtcntaagtatctttctcctcactaatattagatcttga

SEQ ID NO: 44213 - DNA, 71 bp, chicken (Gallus Gallus)
  misc_feature (36): n=a or g
tgttcattaggttttggagacacgtaagaggtatanggcactacatactattactttccaatactgagcat

SEQ ID NO: 44214 - DNA, 71 bp, chicken (Gallus Gallus)
  misc_feature (36): n=g or t
ttcaaaaccctattaccaggataaaatacattctcnagtaattgatacagatttatcttctggcagaagct

SEQ ID NO: 44215 - DNA, 71 bp, chicken (Gallus Gallus)
  misc_feature (36): n=a or g
tctcttcagcccaaccaatggtaggttagagataanacatgaaatagccagtcttttcaacctctcttacc

SEQ ID NO: 44216 - DNA, 71 bp, chicken (Gallus Gallus)
  misc_feature (36): n=a or c
gcttggggatttccagccaagcttgtttcttcctantacagcagaaacatgggcctcgttcatcctctcat

SEQ ID NO: 44217 - DNA, 71 bp, chicken (Gallus Gallus)
  misc_feature (36): n=c or t
tgcaaagctggctgcacttatcagtagtaattcccngttcccttccagttcctgcatttcgtgtgctccac

SEQ ID NO: 44218 - DNA, 71 bp, chicken (Gallus Gallus)
  misc_feature (36): n=a or g
gcaaagtgcctgaaggtacagagcagcaaggcttcngctccatatttgctatgcacgctgaccacttgccc

SEQ ID NO: 44219 - DNA, 71 bp, chicken (Gallus Gallus)
  misc_feature (36): n=a or g
agaggcaggagcattctatggggcagggaagaggancgcaagcaaagaggagagaagtgaaagtgaaaagg

SEQ ID NO: 44220 - DNA, 71 bp, chicken (Gallus Gallus)
  misc_feature (36): n=a or c
aatcttttacttggatatctgaaggaatttaaaggnaaagggagtaactgcttgtcatcaaaccaggcact

SEQ ID NO: 44221 - DNA, 71 bp, chicken (Gallus Gallus)
  misc_feature (36): n=c or t
caacatatcaaatattcctatatctttacatcaccntgtgctgcttcttcagtacgatactttgcatcaat

SEQ ID NO: 44222 - DNA, 71 bp, chicken (Gallus Gallus)
  misc_feature (36): n=c or t
tgactagcagtaacaacaaagtaattctgctataantgtgttgatccaatttcacttgtgtattttgttac

SEQ ID NO: 44223 - DNA, 71 bp, chicken (Gallus Gallus)
  misc_feature (36): n=a or c
aaagttgacaagaaaattcaacaatgaaaatactanctgaaaaacacatgccagtagcaggccagtacatt

SEQ ID NO: 44224 - DNA, 71 bp, chicken (Gallus Gallus)
  misc_feature (36): n=a or g
ttataatccgtgctaactagccccccaggcattttntatctgcaattcacttatgctgaaattataacaaa

SEQ ID NO: 44225 - DNA, 71 bp, chicken (Gallus Gallus)
  misc_feature (36): n=a or g
tactaaaacttaatcaaatgtgtaacttaaatcatntaacttaaatcaactaactgactggtcctattagt

SEQ ID NO: 44226 - DNA, 71 bp, chicken (Gallus Gallus)
  misc_feature (36): n=a or g
acttgtgcatgatttctgtacaggagtcttggaggnagaacaaaaaatagagtagaggtatggtttggaac

SEQ ID NO: 44227 - DNA, 71 bp, chicken (Gallus Gallus)
  misc_feature (36): n=c or t
aattcacttttatcatcttgagctggtaatgcacantgatcagaaattgctgtctcttgcgagtgtcctgt

SEQ ID NO: 44228 - DNA, 71 bp, chicken (Gallus Gallus)
  misc_feature (36): n=a or g
tgattatgtctccaacttacaggctgcctgcaccancagactcatacacttcccagaaacctgaatgacat

SEQ ID NO: 44229 - DNA, 71 bp, chicken (Gallus Gallus)
  misc_feature (36): n=a or g
actgccatgggtgtcgtctttgtgtgcacagatacnggggccctgctgatggcaagcgacttcaaagcact

SEQ ID NO: 44230 - DNA, 71 bp, chicken (Gallus Gallus)
  misc_feature (36): n=c or t
cagagatcaggggaggggagttttaccatggacatnagatgtcagattcaaactgcatgaagtaacacatc

SEQ ID NO: 44231 - DNA, 71 bp, chicken (Gallus Gallus)
  misc_feature (36): n=a or g
gcacactggtccaatctcctacggagctgtaccacngcaagttttaaactgattgtgaggagcaaaataaa

SEQ ID NO: 44232 - DNA, 71 bp, chicken (Gallus Gallus)
  misc_feature (36): n=a or g
aaattagtgagaagcaagtgctgcttgaatatcacnctctcctatttccctgtttacatgactaaacaaga

SEQ ID NO: 44233 - DNA, 71 bp, chicken (Gallus Gallus)
  misc_feature (36): n=c or t
cagtggtcatcagcccactgatactcttggaaatgntgcagaaaagagagaccacttaaaactgtctcagc

SEQ ID NO: 44234 - DNA, 71 bp, chicken (Gallus Gallus)
  misc_feature (36): n=a or g
catgtgatccaaagggatcctggtttggttttggantgggaaggcgtggctccagacgtgctgaaagaaaa

SEQ ID NO: 44235 - DNA, 71 bp, chicken (Gallus Gallus)
  misc_feature (36): n=a or g
ctgtttgatgggaacgccccaagtgattggcttggnaattgttgcacttctgtttcagatccccctccctc

SEQ ID NO: 44236 - DNA, 71 bp, chicken (Gallus Gallus)
  misc_feature (36): n=g or t
actcagaggagactgaagttgcacagtctgaggccncagtgtcaggtggcaaacaagaagaaaaggaggtg

SEQ ID NO: 44237 - DNA, 71 bp, chicken (Gallus Gallus)
  misc_feature (36): n=a or c
gaagcttaaaaattattgcagatatcttactgaccntcgagtgcatctttcagtttaggttactgctgatt

SEQ ID NO: 44238 - DNA, 71 bp, chicken (Gallus Gallus)
  misc_feature (36): n=a or g
agcttgcataagagtgagggggggaagtggggaccnaaagcaaagtctgggttgaaaatgagataccaact

SEQ ID NO: 44239 - DNA, 71 bp, chicken (Gallus Gallus)
  misc_feature (36): n=a or g
ttaatttttaaattatctctaatttgaagaaaaacntactagctggggaactattttacatgccgaaagag

SEQ ID NO: 44240 - DNA, 71 bp, chicken (Gallus Gallus)
  misc_feature (36): n=c or t
ttacgtagtaaagcttgagtggattcttcattcttnccataatcagaagtctccagaatgaagctcctctc

SEQ ID NO: 44241 - DNA, 71 bp, chicken (Gallus Gallus)
  misc_feature (36): n=c or t
gcctcccttggcaatttattgcactacttcattacngtcacctttaacaagattttccaaatacataactt

SEQ ID NO: 44242 - DNA, 71 bp, chicken (Gallus Gallus)
  misc_feature (36): n=c or t
gtcactattgcctgttgctttgctttcaggcctgangcctgctcatttgagcaacgagtcagcacatgatc

SEQ ID NO: 44243 - DNA, 71 bp, chicken (Gallus Gallus)
  misc_feature (36): n=a or g
tttcaaaaatgtctcttcacctttatcagtgttatnaagtgcttctcattagccatcatttccttctcagc

SEQ ID NO: 44244 - DNA, 71 bp, chicken (Gallus Gallus)
  misc_feature (36): n=c or t
gaatgaaaagcaataccttagtgcatgtgaatatantaattctcttacacagctcacagcagtacataaac

SEQ ID NO: 44245 - DNA, 71 bp, chicken (Gallus Gallus)
  misc_feature (36): n=g or t
aacactatgtctagaacttataatgctgcagaatangactgaaaacgaaggcatctggaaacataaagcat

SEQ ID NO: 44246 - DNA, 71 bp, chicken (Gallus Gallus)
  misc_feature (36): n=c or t
ttctttccaaatttagtagctaagctttcaatttcncccagctggcctttccctgccgccagttctgttaa

SEQ ID NO: 44247 - DNA, 71 bp, chicken (Gallus Gallus)
  misc_feature (36): n=g or t
gcttccaggaagtgcagattcagaggtagcccaggntcgactgaatggtagcttagctgtcttctgattta

SEQ ID NO: 44248 - DNA, 71 bp, chicken (Gallus Gallus)
  misc_feature (36): n=g or t
ccatcttctacataaactcctactaacctcagtganatttttaactaggtaaggtgccctatttcaacaca

SEQ ID NO: 44249 - DNA, 71 bp, chicken (Gallus Gallus)
  misc_feature (36): n=g or t
cttacagtattctgtataaaccttacacataacttntgcagggaaagtatggttccattcttttactacat

SEQ ID NO: 44250 - DNA, 71 bp, chicken (Gallus Gallus)
  misc_feature (36): n=g or t
ctaacttctggtagtcaagtagctgtagccaaaaangacttcttcatggaagataccatagagaagcattt

SEQ ID NO: 44251 - DNA, 71 bp, chicken (Gallus Gallus)
  misc_feature (36): n=a or g
atgaggctgtagtgccagctgctgccattcataccnaaataggagaatctaaagactgcagtgttatagtt

SEQ ID NO: 44252 - DNA, 71 bp, chicken (Gallus Gallus)
  misc_feature (36): n=a or g
ggtgaaaagctcagctgtagagtttggcttcccacntgagctactttataagtgagggacagaacacagtt

SEQ ID NO: 44253 - DNA, 71 bp, chicken (Gallus Gallus)
  misc_feature (36): n=g or t
gaacagtacactactcagccctcagcaaactgagantcagcccactcaatttcctcagcagcgcccaaacc

SEQ ID NO: 44254 - DNA, 71 bp, chicken (Gallus Gallus)
  misc_feature (36): n=c or t
atgtttccacttgattttgcttcttttctatttccnatttttaacctaatgaatgccctcctgaaactgca

SEQ ID NO: 44255 - DNA, 71 bp, chicken (Gallus Gallus)
  misc_feature (36): n=c or t
tcagaacaaaagggatcactatatcagaagagttcnacatctgaacactgctgcactagaaatatttgtct

SEQ ID NO: 44256 - DNA, 71 bp, chicken (Gallus Gallus)
  misc_feature (36): n=c or t
agcctctcggctccagaggcctactggcacactcantgcttgttgtgtgttcctccacatttgtaccctca

SEQ ID NO: 44257 - DNA, 71 bp, chicken (Gallus Gallus)
  misc_feature (36): n=c or t
tgctattttctccttttctgttcagcctcagcgatnccataacagctagtgttctcagaaggccattgcct

SEQ ID NO: 44258 - DNA, 71 bp, chicken (Gallus Gallus)
  misc_feature (36): n=c or t
aacctaaaaggaaaataacactttctctaacacacnggtgtcttttaagccaggtgggaccccttaaaaca

SEQ ID NO: 44259 - DNA, 71 bp, chicken (Gallus Gallus)
  misc_feature (36): n=c or t
ccgcttctcaagcaacatttaaccacctattgggcnaagctatcttggcaggtttcgactgaagtgccacg

SEQ ID NO: 44260 - DNA, 71 bp, chicken (Gallus Gallus)
  misc_feature (36): n=a or c
cacacaggcacagaccaagcattttttccccttccnaatgatttctttttggacttcagaatttctagaga

SEQ ID NO: 44261 - DNA, 71 bp, chicken (Gallus Gallus)
  misc_feature (36): n=g or t
gacctggaagggcccagaatgagttttgcccccagnagatggaatgcagtgcgcacatagcagggtaaaga

SEQ ID NO: 44262 - DNA, 71 bp, chicken (Gallus Gallus)
  misc_feature (36): n=a or g
aataagggttaaaccacacaagcatttgctgctacnaggtctggctgctctgaatacgtaaatgtgttgat

SEQ ID NO: 44263 - DNA, 71 bp, chicken (Gallus Gallus)
  misc_feature (36): n=c or t
ggacccagtccaagaaaagcaggctattattccccncacttctatttatccgtagctgtgtccttctgctt

SEQ ID NO: 44264 - DNA, 71 bp, chicken (Gallus Gallus)
  misc_feature (36): n=g or t
atgaggggatccagttgtgccagaatatgctgtacngatttagtgctgagctgtgactcagcacccattag

SEQ ID NO: 44265 - DNA, 71 bp, chicken (Gallus Gallus)
  misc_feature (36): n=c or t
gttttcctagttttgctgtgccaatcatactgcaanccctcgtcttcattctgatcgtggtggaacagcag

SEQ ID NO: 44266 - DNA, 71 bp, chicken (Gallus Gallus)
  misc_feature (36): n=a or g
aaatgtaaatggagtcaacataaaacttccacaacnctcttacacctaaatttctcttggatttcctaagc

SEQ ID NO: 44267 - DNA, 71 bp, chicken (Gallus Gallus)
  misc_feature (36): n=c or t
ccttgttcgctgaacaacaaacccaattcccccagnacaactgactgtgtagactacctggtcaaatcaag

SEQ ID NO: 44268 - DNA, 71 bp, chicken (Gallus Gallus)
  misc_feature (36): n=g or t
cctcgagacagtctggattctgctaatccaggcttntgctttttgtccagatcctcttctccccctcttac

SEQ ID NO: 44269 - DNA, 71 bp, chicken (Gallus Gallus)
  misc_feature (36): n=a or g
atggccagatgtgatgtttctgttgggcttgctgantgaaagaactcagtgaatgactgcagagaccttgt

SEQ ID NO: 44270 - DNA, 71 bp, chicken (Gallus Gallus)
  misc_feature (36): n=c or t
gtcttcctgataaaaccagtgaatggattcatcacnctgatgcagtacagcattttgacaaatagcctata

SEQ ID NO: 44271 - DNA, 71 bp, chicken (Gallus Gallus)
  misc_feature (36): n=c or t
ggaaaaatgtggtataccttgcttagatatctgtanagactgtagtgctcgcacagtctctctgaccaata

SEQ ID NO: 44272 - DNA, 71 bp, chicken (Gallus Gallus)
  misc_feature (36): n=c or t
gtatttatgctgctgtgttcaattgcactgctaaancactcctgtgaaaatgcacatgaggaatgcaccta

SEQ ID NO: 44273 - DNA, 71 bp, chicken (Gallus Gallus)
  misc_feature (36): n=a or g
ttgccagaatactgtcattcaagagcctatcatagnaggcagtagaagcacaacatgaggcagagtattgc

SEQ ID NO: 44274 - DNA, 71 bp, chicken (Gallus Gallus)
  misc_feature (36): n=c or t
ccactacctccttttgacgtcttcacacccactccncctcaccaactttaagcttaatgtctagcctaaaa

SEQ ID NO: 44275 - DNA, 71 bp, chicken (Gallus Gallus)
  misc_feature (36): n=a or c
cagagtcttcagaaaaaaaaacagaacttagccagngcttgggaagcatcattgttacatcaacagtagac

SEQ ID NO: 44276 - DNA, 71 bp, chicken (Gallus Gallus)
  misc_feature (36): n=g or t
tttaaatagcaaagacagaatgagacccattttccnggctctcagataaagtttcactacaaaaatacttt

SEQ ID NO: 44277 - DNA, 71 bp, chicken (Gallus Gallus)
  misc_feature (36): n=c or t
ccaaaccaagccctccaagcacatctagttagtaanctgtaaaagcacagtgatactgcaagtctagaatg

SEQ ID NO: 44278 - DNA, 71 bp, chicken (Gallus Gallus)
  misc_feature (36): n=c or t
ggacggaaacagaagggaaatgctataagatggctngagctttcacccagggaactctggctggtgtgcat

SEQ ID NO: 44279 - DNA, 71 bp, chicken (Gallus Gallus)
  misc_feature (36): n=a or g
gagtagggaggaggttactacaactattctatagcntccagagttcagcaaagtgtggaaatctttctgtt

SEQ ID NO: 44280 - DNA, 71 bp, chicken (Gallus Gallus)
  misc_feature (36): n=g or t
ctccttgataaggcaagtttttattctggcgctctnatcaagcttaagtaaacagccacacttcaactgag

SEQ ID NO: 44281 - DNA, 71 bp, chicken (Gallus Gallus)
  misc_feature (36): n=a or g
ccattttaaaatgaagtcaatgacagtcaagcttgngatagaagaattcactaaaaaactccacagcacat

SEQ ID NO: 44282 - DNA, 71 bp, chicken (Gallus Gallus)
  misc_feature (36): n=a or g
ttatttcagaaaaggttaaaccatatttccaactgncactgtaattcctcagccccatactgtccttttgc

SEQ ID NO: 44283 - DNA, 71 bp, chicken (Gallus Gallus)
  misc_feature (36): n=c or t
atctttgtttctcttaagctatttgatgctcagaantgatcctttatacccgtatacttactaatcttagc

SEQ ID NO: 44284 - DNA, 71 bp, chicken (Gallus Gallus)
  misc_feature (36): n=a or g
agtagttccaggtgaaaaggttctacgagacaatanagaatatcgcgatcaacaaaaccgtctgaaagaaa

SEQ ID NO: 44285 - DNA, 71 bp, chicken (Gallus Gallus)
  misc_feature (36): n=a or c
agtttacataactgaaaccacctctgttttttaacntgatcctttcagtatgaaaaaaattgccttcaaac

SEQ ID NO: 44286 - DNA, 71 bp, chicken (Gallus Gallus)
  misc_feature (36): n=c or t
gttccaagagcaagatctctgccagggccacttttnatttctggactggtgaaaatggattcttcccattt

SEQ ID NO: 44287 - DNA, 71 bp, chicken (Gallus Gallus)
  misc_feature (36): n=c or t
ttcaaacacactggtatgtggcattctagtagttcngcaaactatggaaacaagctacaaggctttgattt

SEQ ID NO: 44288 - DNA, 71 bp, chicken (Gallus Gallus)
  misc_feature (36): n=a or g
tttattatgaaaagatcagaatcctgatagattagngtctttaatatactggattgtgatatgctatttga

SEQ ID NO: 44289 - DNA, 71 bp, chicken (Gallus Gallus)
  misc_feature (36): n=c or t
gctctgaagaagcatgatattttggttttccaaagngcaccacctgtttaccatggtaaattacacttaaa

SEQ ID NO: 44290 - DNA, 71 bp, chicken (Gallus Gallus)
  misc_feature (36): n=c or t
tgccacatactctgatgatagccaatgtgaactacntctaggattcaagagcatgcacagaccatccgatg

SEQ ID NO: 44291 - DNA, 71 bp, chicken (Gallus Gallus)
  misc_feature (36): n=a or g
taacatctgcagaaatgaacataaaattgacgttangatgattaagcaaataggaagggtatcctgaagta

SEQ ID NO: 44292 - DNA, 71 bp, chicken (Gallus Gallus)
  misc_feature (36): n=c or t
gggaattagaatgatgaccaaaaggatagatagaangtgtaatacattatctaggaagtatatggaaatca

SEQ ID NO: 44293 - DNA, 71 bp, chicken (Gallus Gallus)
  misc_feature (36): n=c or t
tttatttttgcattgatatgctgtgtggctgcttantggtcctgaaaatcatttggttttgatactccttt

SEQ ID NO: 44294 - DNA, 71 bp, chicken (Gallus Gallus)
  misc_feature (36): n=a or g
gttatacttctcctcatcttacagtgacgttgaagnactttagcatctctgatttttgtgtgtgattgttt

SEQ ID NO: 44295 - DNA, 71 bp, chicken (Gallus Gallus)
  misc_feature (36): n=c or t
aaggcatagaacaccttgatgcatctcagtgtgcancacaggatggatgtctttttgaccatagcagaaaa

SEQ ID NO: 44296 - DNA, 71 bp, chicken (Gallus Gallus)
  misc_feature (36): n=a or g
aagacaggtagcaatgctactgtagtataattgatnttctgtgaaacacctttgatttgtgttcgagaatg

SEQ ID NO: 44297 - DNA, 71 bp, chicken (Gallus Gallus)
  misc_feature (36): n=a or g
aacaagggaaaatctaactgcccttgaaaaccttgnctacatctataatagttcacaatcattatgaaaat

SEQ ID NO: 44298 - DNA, 71 bp, chicken (Gallus Gallus)
  misc_feature (36): n=c or t
ataaaatttttggcctgaatcttttaatagtacacnatattttgtatattataataattcaaatgtgtttc

SEQ ID NO: 44299 - DNA, 71 bp, chicken (Gallus Gallus)
  misc_feature (36): n=a or g
ttgttttcactacttctacttaaacgaacttcttantaagagaaaaacagtcatctatgatcttttcagat

SEQ ID NO: 44300 - DNA, 71 bp, chicken (Gallus Gallus)
  misc_feature (36): n=a or g
caaaatggaatctacgtatgactagtcctcttattncttcaatgaagaatttcctcatgtgagctaaaata

SEQ ID NO: 44301 - DNA, 71 bp, chicken (Gallus Gallus)
  misc_feature (36): n=a or g
ccttcactttgcgccatgtaagcagcccaacgtganactgaagatgaacagaccttgtctcgtgttgtttg

SEQ ID NO: 44302 - DNA, 71 bp, chicken (Gallus Gallus)
  misc_feature (36): n=a or c
atctgtttgacttgttcagggttctgttagtggtgnagaaaatatattaaaaaaaagcagagttattttaa

SEQ ID NO: 44303 - DNA, 71 bp, chicken (Gallus Gallus)
  misc_feature (36): n=a or g
cccttgctggccaacgcttgtcatctctgtggccancagtctcactctgaatgtcatttgtgagctactcc

SEQ ID NO: 44304 - DNA, 71 bp, chicken (Gallus Gallus)
  misc_feature (36): n=c or t
cagacatccagcgttgagatggctgaatgagccttngcaagcgctttctataatttaaagaatgatcagcc

SEQ ID NO: 44305 - DNA, 71 bp, chicken (Gallus Gallus)
  misc_feature (36): n=a or g
catgagcacgacactcccattcttaagtcatcatcnctatcttgtaaagctgtgaagctccaggcagctac

SEQ ID NO: 44306 - DNA, 71 bp, chicken (Gallus Gallus)
  misc_feature (36): n=a or g
gtttcctatgctgtcctaactaactctaaatcaagncaaacaaggactacatcagtccatgctgtttgcat

SEQ ID NO: 44307 - DNA, 71 bp, chicken (Gallus Gallus)
  misc_feature (36): n=c or t
accaaccattatgtaacacttcaatcactaacaccnaagtaaagtggtacggatagaaaacactgaatatt

SEQ ID NO: 44308 - DNA, 71 bp, chicken (Gallus Gallus)
  misc_feature (36): n=c or t
cctttttgtctgaaaagatccacttctttaatttanataaaatcattggcttttatcttccctatttgtat

SEQ ID NO: 44309 - DNA, 71 bp, chicken (Gallus Gallus)
  misc_feature (36): n=c or t
atacaaagaaaaacagaactgtaagttactgaactngtgtataatgatactggagctggagttcacctttg

SEQ ID NO: 44310 - DNA, 71 bp, chicken (Gallus Gallus)
  misc_feature (36): n=a or g
gctctctctctctttttcccctaatttgcattatgnacagtggaaatacagtacagtggaaggcttccttc

SEQ ID NO: 44311 - DNA, 71 bp, chicken (Gallus Gallus)
  misc_feature (36): n=c or t
tcagtgaggtttacaatctcacatctacaatgtctnagtgtctttgtttggacgtaggacctttggacgtt

SEQ ID NO: 44312 - DNA, 71 bp, chicken (Gallus Gallus)
  misc_feature (36): n=a or g
aaggttttctcaaaagaataggtcgctgcaaagagnagagcgcggcgggcaggcggggggtcggggtgagg

SEQ ID NO: 44313 - DNA, 71 bp, chicken (Gallus Gallus)
  misc_feature (36): n=g or t
tgtctttgttaactgaaaagataatagaattttgtntgttagataatgctccaacactattagtagctcag

SEQ ID NO: 44314 - DNA, 71 bp, chicken (Gallus Gallus)
  misc_feature (36): n=a or g
taatcctggaaagggaagttttaaatgtgcacagtncagagaccctggctgtgttattgggcaccagttta

SEQ ID NO: 44315 - DNA, 71 bp, chicken (Gallus Gallus)
  misc_feature (36): n=c or t
ctttttttcagtgaccaataaatctttgaaatactnagattctgagctgaaattttcatgcttattttctt

SEQ ID NO: 44316 - DNA, 71 bp, chicken (Gallus Gallus)
  misc_feature (36): n=c or t
aaatggtctcaccacagattcatattcaactacaangaatgctatattgaatttgattggttttggaagca

SEQ ID NO: 44317 - DNA, 71 bp, chicken (Gallus Gallus)
  misc_feature (36): n=a or c
gcgccctcactttctagtactcttgcaagagagggnattttcctgcctggttaagacagactgttagctat

SEQ ID NO: 44318 - DNA, 71 bp, chicken (Gallus Gallus)
  misc_feature (36): n=c or t
ttctgtctggtactgttatcaacagcattttgccanaaactgctttataaacaatggaaatagcatagaaa

SEQ ID NO: 44319 - DNA, 71 bp, chicken (Gallus Gallus)
  misc_feature (36): n=c or t
atagcccaatagcttgcagtattagaagaatgagtnaaatttaatttgagccttggtacgtatttcggtac

SEQ ID NO: 44320 - DNA, 71 bp, chicken (Gallus Gallus)
  misc_feature (36): n=a or g
agtgacctgacttgttagaatgtaaaccaacaagcngagtcgcatgacaaaagcaaacaaaaactgtcaag

SEQ ID NO: 44321 - DNA, 71 bp, chicken (Gallus Gallus)
  misc_feature (36): n=c or t
ccacatatgttcatgtttttattttatcatctcttnatccacttttactccacaggttagaccctgccatt

SEQ ID NO: 44322 - DNA, 71 bp, chicken (Gallus Gallus)
  misc_feature (36): n=a or g
aagatccaacccataggaaacatttggtgtgatggnagaggtagttttaactgatttctagtgtgtttatt

SEQ ID NO: 44323 - DNA, 71 bp, chicken (Gallus Gallus)
  misc_feature (36): n=c or t
tctctacatctgattcactgtatgacatgttgacancattaaaatgatcaatacgacttactgtctttctt

SEQ ID NO: 44324 - DNA, 71 bp, chicken (Gallus Gallus)
  misc_feature (36): n=c or t
ttaatcaatgtcaaaacattgtagcaatctactttnattccacattggctcaaataatctgcacttgtctc

SEQ ID NO: 44325 - DNA, 71 bp, chicken (Gallus Gallus)
  misc_feature (36): n=a or g
tgcctattctgacgaataactgtataattatcaggnggtcgtaatcttcaggagatgtaactctttgtatt

SEQ ID NO: 44326 - DNA, 71 bp, chicken (Gallus Gallus)
  misc_feature (36): n=a or c
tcctattttctatccaccaggaagctcttctgatanttgtgtaatttaaggataggaattcaagtgagtaa

SEQ ID NO: 44327 - DNA, 71 bp, chicken (Gallus Gallus)
  misc_feature (36): n=a or g
aggaaagaattcagggaagaagagttagattgtttntatacaatacagagtaaacatggtattctgagtac

SEQ ID NO: 44328 - DNA, 71 bp, chicken (Gallus Gallus)
  misc_feature (36): n=a or g
ttgaatatgtgaagtaaaagatgaaacttcatttgnaaattaactcaacagatcgagttcaaagtccagaa

SEQ ID NO: 44329 - DNA, 71 bp, chicken (Gallus Gallus)
  misc_feature (36): n=a or g
aaaggctgaaagtttttgtacctgttttcaaggctntgttgttactatacctactacacttcactgtgaac

SEQ ID NO: 44330 - DNA, 71 bp, chicken (Gallus Gallus)
  misc_feature (36): n=c or t
tgacttgctattgatgtgcatgataacatatctaanttggttggtacagtgtagtttagaaggtaacttct

SEQ ID NO: 44331 - DNA, 71 bp, chicken (Gallus Gallus)
  misc_feature (36): n=c or t
agacaaatgctcaccatgtggaaccttttgtcacancatatcaggaccattctggatgcccatttatcgtt

SEQ ID NO: 44332 - DNA, 71 bp, chicken (Gallus Gallus)
  misc_feature (36): n=a or g
gaactagatgcctaagaaaaaaatttaatagtacantagatgtttagcatttaagcacaagacttgcaatg

SEQ ID NO: 44333 - DNA, 71 bp, chicken (Gallus Gallus)
  misc_feature (36): n=a or g
cttattgcatgacatacagattgagttttaccctangatttcaggagcccattttccctggctataaattg

SEQ ID NO: 44334 - DNA, 71 bp, chicken (Gallus Gallus)
  misc_feature (36): n=c or t
atctcattatccctgtaattactaatgtcattaatnatgttacagaaaacactctagaccaactccacata

SEQ ID NO: 44335 - DNA, 71 bp, chicken (Gallus Gallus)
  misc_feature (36): n=c or t
ttctaaaatgctttcttaaatgtccttggaccttgntggactgagtgtcatgctcatactcagccattgtt

SEQ ID NO: 44336 - DNA, 71 bp, chicken (Gallus Gallus)
  misc_feature (36): n=g or t
tgggaaccatcatactactttcattaatcacattanttgaaaacctgggatgttatcagttagaaatgaca

SEQ ID NO: 44337 - DNA, 71 bp, chicken (Gallus Gallus)
  misc_feature (36): n=g or t
ctgcagtcaacaatgtgatcgataggatgtatgaanaggttataacttcacagagtcatcaagcaattaag

SEQ ID NO: 44338 - DNA, 71 bp, chicken (Gallus Gallus)
  misc_feature (36): n=c or t
ggtgaaaagagaaatcaagcttaacagcaaatttgnagtctgtaaggaatgcaaacatgacttcaggggaa

SEQ ID NO: 44339 - DNA, 71 bp, chicken (Gallus Gallus)
  misc_feature (36): n=g or t
ccttttgttacatagatttttgatcactgtattaanagaaatattttgtcaatcgcctgggagaacaatga

SEQ ID NO: 44340 - DNA, 71 bp, chicken (Gallus Gallus)
  misc_feature (36): n=a or g
cacaacacgtgaatactgtcaaactaatactgtcanttaagcatcttcactctcaacatcaaattatatac

SEQ ID NO: 44341 - DNA, 71 bp, chicken (Gallus Gallus)
  misc_feature (36): n=a or c
ttttttaattatctttaatgtaacttcatttacagnctgatactagagcatatgaatggaaaagagtttat

SEQ ID NO: 44342 - DNA, 71 bp, chicken (Gallus Gallus)
  misc_feature (36): n=c or t
gcaagacatgcctgccaacagatgcacagtgcacantgtataatgaacactcaagaaaatcaactcctagg

SEQ ID NO: 44343 - DNA, 71 bp, chicken (Gallus Gallus)
  misc_feature (36): n=g or t
ttttgtgtgcaaagcaagcagtgaatgacattattntgtcacaaagctatgtacttctgttgttttctgag

SEQ ID NO: 44344 - DNA, 71 bp, chicken (Gallus Gallus)
  misc_feature (36): n=a or g
aaaaatctagtaatataatatgtttgagtcatatanctatatatatgtgatagttcccagaccaacttgca

SEQ ID NO: 44345 - DNA, 71 bp, chicken (Gallus Gallus)
  misc_feature (36): n=a or c
tacatcacagtaggtttcaaacagctgtttttttgnaaggctcagaaaggttggtggttttttcttaattc

SEQ ID NO: 44346 - DNA, 71 bp, chicken (Gallus Gallus)
  misc_feature (36): n=a or g
ctgaaatttgaaagtggtgagtcattgtccttcacngatttttatggcataattgctcactggcaagtata

SEQ ID NO: 44347 - DNA, 71 bp, chicken (Gallus Gallus)
  misc_feature (36): n=c or t
agggcatttcagtcagcataatttggaaatctagtnctggtgctccttctctgatgtctattctcttcaac

SEQ ID NO: 44348 - DNA, 71 bp, chicken (Gallus Gallus)
  misc_feature (36): n=c or t
acttaaaaataatggatcaaattcttctctacaaanactactactgaagtcagtggacttatgccaaggat

SEQ ID NO: 44349 - DNA, 71 bp, chicken (Gallus Gallus)
  misc_feature (36): n=a or g
gacaggggtctaaagtctatgagatgggagaagccnggctacagcttagtagcaaagcaattatcgaatat

SEQ ID NO: 44350 - DNA, 71 bp, chicken (Gallus Gallus)
  misc_feature (36): n=a or g
aaaggtataggaaataaatagaacctttcgcgtgtnacaaaggcgaagaaaatcatcccttcccaccctgc

SEQ ID NO: 44351 - DNA, 71 bp, chicken (Gallus Gallus)
  misc_feature (36): n=a or g
agcaatctaattcttacatatgttaagtagataatntgtaccggaggaaaggaggtatagaaaaatgtaat

SEQ ID NO: 44352 - DNA, 71 bp, chicken (Gallus Gallus)
  misc_feature (36): n=a or g
aatgcaacttcttttgcatcctaccgcaattcaccncaaagggaatgtaaattatggcagtgtgaaagcaa

SEQ ID NO: 44353 - DNA, 71 bp, chicken (Gallus Gallus)
  misc_feature (36): n=g or t
tgttttcattgtggttagcgcttggactgataaggngtgctggatactgcagtccgtgttctcctgaatac

SEQ ID NO: 44354 - DNA, 71 bp, chicken (Gallus Gallus)
  misc_feature (36): n=c or t
gagttcttttccacatcacaaatagttagctattgncactctcaaataaggaactgtaaccaaaatctaat

SEQ ID NO: 44355 - DNA, 71 bp, chicken (Gallus Gallus)
  misc_feature (36): n=a or g
agttctgtaacatgcatttttccataacagacagcngttgcagcagaactggttgagatgagtaacatact

SEQ ID NO: 44356 - DNA, 71 bp, chicken (Gallus Gallus)
  misc_feature (36): n=a or c
aacatcaacttcatagtgcagggcactgtgagtgtnaggcatgcttcagctccgcccagcagctggtaggc

SEQ ID NO: 44357 - DNA, 71 bp, chicken (Gallus Gallus)
  misc_feature (36): n=a or g
caaataattactttctggaggcttttttggattgtncagttagtcatgcgaatcattttggtatatagctt

SEQ ID NO: 44358 - DNA, 71 bp, chicken (Gallus Gallus)
  misc_feature (36): n=c or t
taacatgacaggaatggtttgagaatcattgaatgnttatgtgtactacataagtttctggaacaacttgt

SEQ ID NO: 44359 - DNA, 71 bp, chicken (Gallus Gallus)
  misc_feature (36): n=c or t
tccttgtgccaaagtattgaatgtgaacattaaagnaaagttgttaacttgataagtctgaactgatgagt

SEQ ID NO: 44360 - DNA, 71 bp, chicken (Gallus Gallus)
  misc_feature (36): n=c or t
caaggtacctatccctggaccttctgaaggcaagcnacctgcactcagaagcagccatccatttgagctcc

SEQ ID NO: 44361 - DNA, 71 bp, chicken (Gallus Gallus)
  misc_feature (36): n=c or t
taaagaagtcagttcttatctatgtttctgaagtangctatagaggtacactagagacaggatttccaaac

SEQ ID NO: 44362 - DNA, 71 bp, chicken (Gallus Gallus)
  misc_feature (36): n=g or t
actttcattcagcagtgtcagtttttcttttacaanggagagatcgtagaagcaccgaacccagtggcatg

SEQ ID NO: 44363 - DNA, 71 bp, chicken (Gallus Gallus)
  misc_feature (36): n=c or t
ttgtgcctaaaaatctttgttgcaatattatatctnattttacatgaggataaattgaagcctctttcaac

SEQ ID NO: 44364 - DNA, 71 bp, chicken (Gallus Gallus)
  misc_feature (36): n=c or t
ggtcttcctctctgaaatatccccagtagtctttangatataaactactcagtgctaaaatgctgatgtta

SEQ ID NO: 44365 - DNA, 71 bp, chicken (Gallus Gallus)
  misc_feature (36): n=c or t
gccctgaagttactttgtatttatatagcttcaaantgaatatttattggatagagcacaggttacttccc

SEQ ID NO: 44366 - DNA, 71 bp, chicken (Gallus Gallus)
  misc_feature (36): n=a or g
catgtttctcttatacagttggaccgtcctcattgntattggcttgacttactgtgagggagagaaagcag

SEQ ID NO: 44367 - DNA, 71 bp, chicken (Gallus Gallus)
  misc_feature (36): n=g or t
aacagctaaggaataagctgcctttctcagtttagnaaactcatgctcttggcttaaatctcttcttctga

SEQ ID NO: 44368 - DNA, 71 bp, chicken (Gallus Gallus)
  misc_feature (36): n=c or t
ctaatacatccgtaaaaggtatggcctaaatacacngtattgtatcgactatggcagcctttagtaacctc

SEQ ID NO: 44369 - DNA, 71 bp, chicken (Gallus Gallus)
  misc_feature (36): n=c or t
ccttcaagagcccatatgctctcaaaggacaacttnagataacccactgtctatttcttccttgttccctt

SEQ ID NO: 44370 - DNA, 71 bp, chicken (Gallus Gallus)
  misc_feature (36): n=g or t
tcagtagcaacctcaagggagctcaagcctggacancacacagcaacaccacatttggggatctgggtgcc

SEQ ID NO: 44371 - DNA, 71 bp, chicken (Gallus Gallus)
  misc_feature (36): n=c or t
tgaactgggaggtctatgtcttctgatagcttagtngttgctggaaatgagcaatgaaaagggcaaacttc

SEQ ID NO: 44372 - DNA, 71 bp, chicken (Gallus Gallus)
  misc_feature (36): n=a or g
tcttaactatagaggatgctgaaaaatctgtagatntaccattcactacaacactgcattttagccacgta

SEQ ID NO: 44373 - DNA, 71 bp, chicken (Gallus Gallus)
  misc_feature (36): n=c or t
gatttctagggccacatctctttgtcttcacactgnagttagctcaacagtccttggagtctctctcagtg

SEQ ID NO: 44374 - DNA, 71 bp, chicken (Gallus Gallus)
  misc_feature (36): n=a or g
caaagtaacagcctactgtgtctatacagagacagnaagatatgtatttgtaacaacagtatgccaaaaca

SEQ ID NO: 44375 - DNA, 71 bp, chicken (Gallus Gallus)
  misc_feature (36): n=a or g
tactttgagcctcttgcattatttgttaactttgcnagcgtaataatagaggataaacaaatcgtatttaa

SEQ ID NO: 44376 - DNA, 71 bp, chicken (Gallus Gallus)
  misc_feature (36): n=a or g
attagattgaatagaaataagtactaagcgaaagtntgtcgtgttaataaggctggatacacagctatgta

SEQ ID NO: 44377 - DNA, 71 bp, chicken (Gallus Gallus)
  misc_feature (36): n=c or t
ttaggtagaactatgaatttatgtatgggcacaganggcccacacatgaaatgcaaccattacaccaagcc

SEQ ID NO: 44378 - DNA, 71 bp, chicken (Gallus Gallus)
  misc_feature (36): n=c or t
gatctctaacagtatgaaggacttcacagagacagngcacacgggggttcacagttacatagaaaaatcta

SEQ ID NO: 44379 - DNA, 71 bp, chicken (Gallus Gallus)
  misc_feature (36): n=a or c
gagctgctccaaatcgcttaatagttcttaagatcnacctggcaagagaacaagcataggagcagataagt

SEQ ID NO: 44380 - DNA, 71 bp, chicken (Gallus Gallus)
  misc_feature (36): n=a or g
aaaagttacattgcttgtctgacatggattaattgngaagcctgtgcagaagttttgtgacctgaaatgca

SEQ ID NO: 44381 - DNA, 71 bp, chicken (Gallus Gallus)
  misc_feature (36): n=a or g
aatagacgggacacgagctgtggtttggggccaggnagccaacagtgtttgggacctctgaacaggaacag

SEQ ID NO: 44382 - DNA, 71 bp, chicken (Gallus Gallus)
  misc_feature (36): n=a or g
ctctctcttactactttggtaggctccaactggagnagcagccaactgtaggatgagcataatttggaggg

SEQ ID NO: 44383 - DNA, 71 bp, chicken (Gallus Gallus)
  misc_feature (36): n=a or c
tttgttgttctaaaattagctgttcattggcaaaancagatctttaagataactgcaggtatgtgaaatcc

SEQ ID NO: 44384 - DNA, 71 bp, chicken (Gallus Gallus)
  misc_feature (36): n=g or t
tgccaaagtcttagaaagcacatgaaaaaattcttngaatcttcacacccaagcacctctccatctttttt

SEQ ID NO: 44385 - DNA, 71 bp, chicken (Gallus Gallus)
  misc_feature (36): n=a or g
tgaaactactgtgtgatatactgctataataagagnaaactaagggagatggtggcctttttccaaagttg

SEQ ID NO: 44386 - DNA, 71 bp, chicken (Gallus Gallus)
  misc_feature (36): n=a or g
gaaatttctcttctttctcactagaatttccaagtnctgttagatctagaagtgcaatcaagaagttttaa

SEQ ID NO: 44387 - DNA, 71 bp, chicken (Gallus Gallus)
  misc_feature (36): n=c or t
gttaaaatgagatctcatgtcagtgttgttacttcntcctgacagctgaatgcagtttgaaaattttacaa

SEQ ID NO: 44388 - DNA, 71 bp, chicken (Gallus Gallus)
  misc_feature (36): n=a or g
tagcatcagactggtatagagaaatagaaagaaaantacttctaattatatgtttaactatcaggatagta

SEQ ID NO: 44389 - DNA, 71 bp, chicken (Gallus Gallus)
  misc_feature (36): n=a or c
atgacagtctgtgcaaaagacaggtagggaacttantgtaagtgctgctgtggatgaatttgtggaaagtc

SEQ ID NO: 44390 - DNA, 71 bp, chicken (Gallus Gallus)
  misc_feature (36): n=c or t
tgctgaagaactgaacagctacaggtaattacaaantgtactcacttgtttgaaagtgaacaaaaggcagt

SEQ ID NO: 44391 - DNA, 71 bp, chicken (Gallus Gallus)
  misc_feature (36): n=a or c
tgcacttggaaatgaacacagcaaaacctccagcanaattgcaaacggctgtgagagttaaattcatcttt

SEQ ID NO: 44392 - DNA, 71 bp, chicken (Gallus Gallus)
  misc_feature (36): n=c or t
gggtatcagcagattgatacctctgtatttcttttnttcaaatccaattcaaggttttcttaaacaaacaa

SEQ ID NO: 44393 - DNA, 71 bp, chicken (Gallus Gallus)
  misc_feature (36): n=a or g
aaggctctagcccagccgtgtccaacccacaggctncatgtggcccagcccagcctcagatactcactgct

SEQ ID NO: 44394 - DNA, 71 bp, chicken (Gallus Gallus)
  misc_feature (36): n=g or t
cctttgaatttcttgcatttttgaaagcgcttcgtntttatgttcttccttcttagatgtctgatcactgg

SEQ ID NO: 44395 - DNA, 71 bp, chicken (Gallus Gallus)
  misc_feature (36): n=c or t
acatatcagatgtaatgaaattagaagtggtgtcanctttcttgggcagtggaatctctgcttttttgttt

SEQ ID NO: 44396 - DNA, 71 bp, chicken (Gallus Gallus)
  misc_feature (36): n=c or t
caaaagtgactgcggtaattaggagtgtttacagangatttggccaaaggtcagagcccgttacagcactt

SEQ ID NO: 44397 - DNA, 71 bp, chicken (Gallus Gallus)
  misc_feature (36): n=a or g
acaggacctgtgggcaacaaaaaggggagccaaganttcaagttctgctatctgagcggagctcacctccc

SEQ ID NO: 44398 - DNA, 71 bp, chicken (Gallus Gallus)
  misc_feature (36): n=a or g
taagactgtgactgtgtgtgttcttaggatggagangttgacctgaagcttctcaccaaagtcttggctcc

SEQ ID NO: 44399 - DNA, 71 bp, chicken (Gallus Gallus)
  misc_feature (36): n=g or t
aatgggattcttttccactgtgttccttttttaggnttataggcagtaggcattgtcaggaagtattttgt

SEQ ID NO: 44400 - DNA, 71 bp, chicken (Gallus Gallus)
  misc_feature (36): n=c or t
gaggtgctgacagccaatttcagtgactctgatganatggcagcggtcaaacgacatccagctctcagtgc

SEQ ID NO: 44401 - DNA, 71 bp, chicken (Gallus Gallus)
  misc_feature (36): n=a or g
ggcctggacaagctctcagattccacgtttctcttnccctcacgaccagctcaaagaggtgagttccataa

SEQ ID NO: 44402 - DNA, 71 bp, chicken (Gallus Gallus)
  misc_feature (36): n=c or t
cactacacagatttttgctcaaatgtttatagttgnttcagactgctatagttcccatggattctgtcagt

SEQ ID NO: 44403 - DNA, 71 bp, chicken (Gallus Gallus)
  misc_feature (36): n=c or t
tccacatactttgattttgacaaaccagattaattngattgattatagaatcatggatctgtcatggaaga

SEQ ID NO: 44404 - DNA, 71 bp, chicken (Gallus Gallus)
  misc_feature (36): n=c or t
gcctcttaaggtgggctcacatgatgttgtatagantgaaacataactgtccttaaaactgcaatgtaaga

SEQ ID NO: 44405 - DNA, 71 bp, chicken (Gallus Gallus)
  misc_feature (36): n=c or t
gtcaattctgtatggtctgacatatgtctccacganagcaagcccagacctactcccctcaaccagaaaca

SEQ ID NO: 44406 - DNA, 71 bp, chicken (Gallus Gallus)
  misc_feature (36): n=c or t
gaataaatgttaataatgcttattatgttgtgctangattgcttcccacccagaagttaacagcagtatca

SEQ ID NO: 44407 - DNA, 71 bp, chicken (Gallus Gallus)
  misc_feature (36): n=a or g
gcacatgtgggaggctgtgtgtctgtctgcaccacntgtgtccttggcttaggtctccagcactggaagcg

SEQ ID NO: 44408 - DNA, 71 bp, chicken (Gallus Gallus)
  misc_feature (36): n=c or t
gagacagggattcaaaacttaccatctgaaaggganggcaaacttggaagtctgtttcgtcctgcaatcaa

SEQ ID NO: 44409 - DNA, 71 bp, chicken (Gallus Gallus)
  misc_feature (36): n=c or t
acaataaacttacggagtggaaggtaagagattcancacttaaatagcagtgagatggacagaatctttct

SEQ ID NO: 44410 - DNA, 71 bp, chicken (Gallus Gallus)
  misc_feature (36): n=a or g
aaaacttggcagaagccaccaggctccttggagggnaaggacagcagcatcccaccgtggcagagctgcag

SEQ ID NO: 44411 - DNA, 71 bp, chicken (Gallus Gallus)
  misc_feature (36): n=c or t
ttgttctggactcacctcagcttttccttgctttgnccccacagatcagcggtcttctcaggagccatgtg

SEQ ID NO: 44412 - DNA, 71 bp, chicken (Gallus Gallus)
  misc_feature (36): n=c or t
gcttcatttagaaaagtttacagatcagataattanttgtaccttcagacaggactcctgggagatgtgta

SEQ ID NO: 44413 - DNA, 71 bp, chicken (Gallus Gallus)
  misc_feature (36): n=a or c
cctggctgctgtcagaagtttggtcttgctgtgatntctgtcctgttccattactgaagctcttagtcctg

SEQ ID NO: 44414 - DNA, 71 bp, chicken (Gallus Gallus)
  misc_feature (36): n=a or g
gatttgcacacttctcaacttcagaaggacatggangatatactaaagtgtattgtttcctgaatacacac

SEQ ID NO: 44415 - DNA, 71 bp, chicken (Gallus Gallus)
  misc_feature (36): n=a or g
tcattttaaattatttaagtatgtgttacctgatcntctctcatctcctttttgatctgaacccatttaac

SEQ ID NO: 44416 - DNA, 71 bp, chicken (Gallus Gallus)
  misc_feature (36): n=c or t
tcctctgcttgaaggacagacaagacactcacatgntcgggacattgggcccggcaccatcttcccccttg

SEQ ID NO: 44417 - DNA, 71 bp, chicken (Gallus Gallus)
  misc_feature (36): n=a or g
ccagatgtgctatgattcctactgtgcttttgtctnctaacagcagtctctgagttcagctcctctggcac

SEQ ID NO: 44418 - DNA, 71 bp, chicken (Gallus Gallus)
  misc_feature (36): n=a or g
gaaaagaccacagagtcttttaaaaaatcacttacnaagtgtgcttttaccttcaaagtgtactgcaaaat

SEQ ID NO: 44419 - DNA, 71 bp, chicken (Gallus Gallus)
  misc_feature (36): n=a or g
gaaataagaccttggagtcttaattcttcttttgcnttcaaacctcagttaatctctcctttgcttttaaa

SEQ ID NO: 44420 - DNA, 71 bp, chicken (Gallus Gallus)
  misc_feature (36): n=g or t
aggaacacttgatataaaggccataacaaatgtcanctagattacaggaatattcacataacttaagtctt

SEQ ID NO: 44421 - DNA, 71 bp, chicken (Gallus Gallus)
  misc_feature (36): n=c or t
catatacattaaaatatatgttgatccattcttgtnacctgcgagctctctataggtaactattttctgaa

SEQ ID NO: 44422 - DNA, 71 bp, chicken (Gallus Gallus)
  misc_feature (36): n=a or g
aactagctttccttactgttgttctgaggtctctcntaactctcattaactgtttccaaactaacgtttct

SEQ ID NO: 44423 - DNA, 71 bp, chicken (Gallus Gallus)
  misc_feature (36): n=a or g
taccagttaggtaataacttggtagcaaaagagacntgaaactgctaacatactgtggagacaaagagccc

SEQ ID NO: 44424 - DNA, 71 bp, chicken (Gallus Gallus)
  misc_feature (36): n=g or t
taaaacataaattatgggatttcttttttttccttntaacttttagcccagttcagtcctctctttgtgct

SEQ ID NO: 44425 - DNA, 71 bp, chicken (Gallus Gallus)
  misc_feature (36): n=c or t
agttttttctagtatcccatatttttatacactatngcagtcctgctttcatagtacagtgatttggattt

SEQ ID NO: 44426 - DNA, 71 bp, chicken (Gallus Gallus)
  misc_feature (36): n=c or t
tcaccacaatttctgaattctgaaaaactggtgttnttgggttgaggaggcagtgtgaggttttcattgtc

SEQ ID NO: 44427 - DNA, 71 bp, chicken (Gallus Gallus)
  misc_feature (36): n=a or g
tgtgacatgtgtcaaacgctggactctaaatgtgantgtttatcttagactagtttccccatatttcttag

SEQ ID NO: 44428 - DNA, 71 bp, chicken (Gallus Gallus)
  misc_feature (36): n=c or t
gataagaccctgataacgcagatgtgatgtcacttntgttatacttgtagatatttttaatgcctttcatt

SEQ ID NO: 44429 - DNA, 71 bp, chicken (Gallus Gallus)
  misc_feature (36): n=a or g
aaaacaggtggaaaataggcatatacacatcttcantacctaccttgtaagtcagaaagccttgtactgta

SEQ ID NO: 44430 - DNA, 71 bp, chicken (Gallus Gallus)
  misc_feature (36): n=a or g
gtccctgtttctcatggtatgatattatatgcagcntgattgttgggtttaaaaacatggtaaatgttggc

SEQ ID NO: 44431 - DNA, 71 bp, chicken (Gallus Gallus)
  misc_feature (36): n=g or t
gtttattacaaagataactttcatgcattgatccanaccagtccttaactgttacaagtgctgtttaatgc

SEQ ID NO: 44432 - DNA, 71 bp, chicken (Gallus Gallus)
  misc_feature (36): n=c or t
ggaagagtagaggagaacactgctttcttttgtttntctgatatatgttttagataacttcatataagtgc

SEQ ID NO: 44433 - DNA, 71 bp, chicken (Gallus Gallus)
  misc_feature (36): n=a or c
ttttcctttccatagcacaatcccaagcctttcacncaaagctagagccacaaaggatgggagtgttttct

SEQ ID NO: 44434 - DNA, 71 bp, chicken (Gallus Gallus)
  misc_feature (36): n=a or g
tgctgtcactgatcctttgtgcaattagcaacttcngaattaagcttgatgttatttaaataacatattcc

SEQ ID NO: 44435 - DNA, 71 bp, chicken (Gallus Gallus)
  misc_feature (36): n=a or g
tttacttggagtggggaagttttagcagttgaaaantgaagctgacagctaagtaaggatgttgttgttat

SEQ ID NO: 44436 - DNA, 71 bp, chicken (Gallus Gallus)
  misc_feature (36): n=c or t
aggaagaatctttactgtaaatgggaagattccagngcaggcaattagcaggtgaaggacaaatgtaccca

SEQ ID NO: 44437 - DNA, 71 bp, chicken (Gallus Gallus)
  misc_feature (36): n=a or g
tttcaatttcttagtagctttagcagtaacaaaagnaactaacaggacatggaacagaacatcttttttga

SEQ ID NO: 44438 - DNA, 71 bp, chicken (Gallus Gallus)
  misc_feature (36): n=c or t
aagagagaataaaatctgatatgtggaacctcatcntcacaaaaagcaaagtgttgtagctcacccacagt

SEQ ID NO: 44439 - DNA, 71 bp, chicken (Gallus Gallus)
  misc_feature (36): n=c or t
ttgatcagaaaaataaattaactgactctgaacttntatgcacaacactcataaaactgaagccaaagaca

SEQ ID NO: 44440 - DNA, 71 bp, chicken (Gallus Gallus)
  misc_feature (36): n=g or t
cttaaccaattaagttgagcaaaaaggttatgttcnttgttaatatgcacttgaaaagggcaaataccaag

SEQ ID NO: 44441 - DNA, 71 bp, chicken (Gallus Gallus)
  misc_feature (36): n=c or t
ctaaaatctggtggtctggagatgaagaggtttggncttctttgttctaataaatttctatagccaagttg

SEQ ID NO: 44442 - DNA, 71 bp, chicken (Gallus Gallus)
  misc_feature (36): n=c or t
aaaagtagtaatcatgctaaaattgatgttaaaacnttcagtattcaatattgtgaaagcaaatttgcata

SEQ ID NO: 44443 - DNA, 71 bp, chicken (Gallus Gallus)
  misc_feature (36): n=a or g
cacacacctaaaagcaggacatgcttgagccatagngaaattgaacaaagtatttcccttgtgctgtaagg

SEQ ID NO: 44444 - DNA, 71 bp, chicken (Gallus Gallus)
  misc_feature (36): n=a or g
cctggctgagcacgaaaaccagacggaatactgaangagctctgtctcttccccgagggctagactttctt

SEQ ID NO: 44445 - DNA, 71 bp, chicken (Gallus Gallus)
  misc_feature (36): n=c or t
ttatatgcttgattataggttacaaattgctaattnttcagccctggttttattgtgaatcttaggttact

SEQ ID NO: 44446 - DNA, 71 bp, chicken (Gallus Gallus)
  misc_feature (36): n=c or t
tcaacattatgcaggacctatgttttgtaaaggacngcctgaaggtaccgtcaccaaagcagggaaggatc

SEQ ID NO: 44447 - DNA, 71 bp, chicken (Gallus Gallus)
  misc_feature (36): n=c or t
gaaaagtcacattttaaaagggatgcatttactgantttctcttatcttttacagggctaagttagtaatt

SEQ ID NO: 44448 - DNA, 71 bp, chicken (Gallus Gallus)
  misc_feature (36): n=a or g
tcacaaaaataaatatattgtataattctggatganaaagacattgaaacaactgattccatgaacaacag

SEQ ID NO: 44449 - DNA, 71 bp, chicken (Gallus Gallus)
  misc_feature (36): n=c or t
aactagcaaatttcatctataaagaaatgatccaanaaagtcaattggcaaagctgtggtacccaatgtta

SEQ ID NO: 44450 - DNA, 71 bp, chicken (Gallus Gallus)
  misc_feature (36): n=a or g
aattagttgaatctggtggacttcaagaggcagagnatttctctcctagtaagttcaagactgctttggta

SEQ ID NO: 44451 - DNA, 71 bp, chicken (Gallus Gallus)
  misc_feature (36): n=c or t
ctactgaatttttttgtaaaatgccatgccactttnctgcctgtcctatatggtaacacgtactacttctg

SEQ ID NO: 44452 - DNA, 71 bp, chicken (Gallus Gallus)
  misc_feature (36): n=c or t
ttcccagaaactttatgcttggtttcttgcatgtgnaagagatgcctccgttataatatgaatgggtagtt

SEQ ID NO: 44453 - DNA, 71 bp, chicken (Gallus Gallus)
  misc_feature (36): n=c or t
tcgttctttctaggagttttcattagcctataaatnctttataagtgtcagaatataaggaaaaagtaatt

SEQ ID NO: 44454 - DNA, 71 bp, chicken (Gallus Gallus)
  misc_feature (36): n=a or g
tccttatctctttcaaacatcagtctcacttttggnctcaaaaatgtctcaataccctgttactgacagtg

SEQ ID NO: 44455 - DNA, 71 bp, chicken (Gallus Gallus)
  misc_feature (36): n=g or t
acttacaaaagaccctctgaggtagaaagttgctcnctgaggtgaaactcggaagtgaggcagtggaggcc

SEQ ID NO: 44456 - DNA, 71 bp, chicken (Gallus Gallus)
  misc_feature (36): n=c or t
gggaaagtcaatctctcctcaggaaaggtttctacngcagaaaaagcagatgacagtgaactgaactcatt

SEQ ID NO: 44457 - DNA, 71 bp, chicken (Gallus Gallus)
  misc_feature (36): n=c or t
aggataaattaggacaacagcctaatgttgtagacngtatttatcatccaggacatgtaaacaaacaggta

SEQ ID NO: 44458 - DNA, 71 bp, chicken (Gallus Gallus)
  misc_feature (36): n=c or t
ctttattcttcacacaattctgtgcctatcattgcntcgagtgaagcatgtcaccactcttctcttccaaa

SEQ ID NO: 44459 - DNA, 71 bp, chicken (Gallus Gallus)
  misc_feature (36): n=a or c
tctgtagaatttgtgtctagccacacacatcctccncacatattttgctgtttccatatcttcctgccaaa

SEQ ID NO: 44460 - DNA, 71 bp, chicken (Gallus Gallus)
  misc_feature (36): n=c or t
aaagagtgaggctgtgcagtgtacactgaaaggtgncacatactaatcactaaatgaactgctgagaatac

SEQ ID NO: 44461 - DNA, 71 bp, chicken (Gallus Gallus)
  misc_feature (36): n=a or g
tacagttgaaggaatggaattgagaccatagttcanagatcctgtgatttgcaggaccgggctctcagttt

SEQ ID NO: 44462 - DNA, 71 bp, chicken (Gallus Gallus)
  misc_feature (36): n=a or g
ttgtgaattcacagcatacaaaatatggcattggtnggcagtttatgctgcctttcagttggacacagctg

SEQ ID NO: 44463 - DNA, 71 bp, chicken (Gallus Gallus)
  misc_feature (36): n=g or t
ctaactaaatttttctccatgcactgaggaagtacntacagtgaagaaagtcaaaacaccatactatagag

SEQ ID NO: 44464 - DNA, 71 bp, chicken (Gallus Gallus)
  misc_feature (36): n=a or g
tgagacaggaggtggagaggtctctggatatcaccngcttcttactgctgtttgaaaaagaactaattatg

SEQ ID NO: 44465 - DNA, 71 bp, chicken (Gallus Gallus)
  misc_feature (36): n=a or c
ctgttctctggtttgggatgtcctcggtcacttgtncatttataacaaacacatgcccaattctgcagctt

SEQ ID NO: 44466 - DNA, 71 bp, chicken (Gallus Gallus)
  misc_feature (36): n=c or t
atagcatctgaagaaggatttagggctaacacatanctgaaacaataatgaagtttcaaaatacagcagga

SEQ ID NO: 44467 - DNA, 71 bp, chicken (Gallus Gallus)
  misc_feature (36): n=a or g
agaaataatagaattattatgtatgctttggatgtnttcttccacagatttcagcaacattccaatagaat

SEQ ID NO: 44468 - DNA, 71 bp, chicken (Gallus Gallus)
  misc_feature (36): n=a or g
cgcttcctgaggggaggctgagtcacttgaagttgntaggagatgtccactatctttctactttagcattc

SEQ ID NO: 44469 - DNA, 71 bp, chicken (Gallus Gallus)
  misc_feature (36): n=c or t
ataaggccaaatattgaatctccatcaaaagtgcangtgttttaggaactaaatggtccatctataagcag

SEQ ID NO: 44470 - DNA, 71 bp, chicken (Gallus Gallus)
  misc_feature (36): n=a or g
actcctcctctagctgggctgtgggagacaaacagnctgatgttggctaccaggtgggtatattacagacg

SEQ ID NO: 44471 - DNA, 71 bp, chicken (Gallus Gallus)
  misc_feature (36): n=a or g
tttcattaggttctaacacagctacatgctgcaganaagatccagtagcaaactctgtgaatgagcccggc

SEQ ID NO: 44472 - DNA, 71 bp, chicken (Gallus Gallus)
  misc_feature (36): n=c or t
tgacaatacacaaaagaagaatcaagaataaagcanaagctaggacaagtttgtcaaagtcatcatcttac

SEQ ID NO: 44473 - DNA, 71 bp, chicken (Gallus Gallus)
  misc_feature (36): n=a or g
gttcaaaaatagaagtaataaaaataaaaatcagtnttgtctctcttttgctatgctgttgaatgcttttc

SEQ ID NO: 44474 - DNA, 71 bp, chicken (Gallus Gallus)
  misc_feature (36): n=a or g
agtgttaattgaagtgttggggaatcgctgctcctntatggcttgaagcagaggaaacaaggggccctcac

SEQ ID NO: 44475 - DNA, 71 bp, chicken (Gallus Gallus)
  misc_feature (36): n=c or t
aaaaggtgaacctcagctgacacttggggaggtccnatgatgcaaggtgcaaaaaggtactgtgagagtct

SEQ ID NO: 44476 - DNA, 71 bp, chicken (Gallus Gallus)
  misc_feature (36): n=a or g
tgctatattttattcttcttgtatagcaagatgatntgcaacagcacttcctgggcttatgtgaggttgcc

SEQ ID NO: 44477 - DNA, 71 bp, chicken (Gallus Gallus)
  misc_feature (36): n=a or g
tcctttttttgatttttagcattggttgggtatcanggaagagcaccttcatagtctgtattaatgaaact

SEQ ID NO: 44478 - DNA, 71 bp, chicken (Gallus Gallus)
  misc_feature (36): n=g or t
ttattcagtggttgattgaatattgttgtgcaattnttctcatgaattagtttatatctatgttgctttca

SEQ ID NO: 44479 - DNA, 71 bp, chicken (Gallus Gallus)
  misc_feature (36): n=a or g
actgttacaaacacaatttctatactctccagttcngattggaaagcaaaactcaggcacttcctcctcac

SEQ ID NO: 44480 - DNA, 71 bp, chicken (Gallus Gallus)
  misc_feature (36): n=a or g
ctaacgcagcacaagagaaggtctggagtcccctgngcatgttacagacttgtcctgaagcatataagggt

SEQ ID NO: 44481 - DNA, 71 bp, chicken (Gallus Gallus)
  misc_feature (36): n=c or t
acagttctgtccctgcacacaaaccctgctacactncacagagcttagtgtgggctacagaagaaaaaaca

SEQ ID NO: 44482 - DNA, 71 bp, chicken (Gallus Gallus)
  misc_feature (36): n=a or g
ccttgcatgtatgcctctatttgccgaatgagctcntaagacttggatcggtccagaagcgtacgaatagc

SEQ ID NO: 44483 - DNA, 71 bp, chicken (Gallus Gallus)
  misc_feature (36): n=a or g
gcttggtgagccactgtactgcatcttgctgcatgntgttgccaaatacattataactttctgcttacact

SEQ ID NO: 44484 - DNA, 71 bp, chicken (Gallus Gallus)
  misc_feature (36): n=a or g
gcatcctgagttctgtaaatcaacactgaataactnaatttatcctaaacactacagaatgcccagccttg

SEQ ID NO: 44485 - DNA, 71 bp, chicken (Gallus Gallus)
  misc_feature (36): n=c or t
cttccttgtgcagctgaactagaccagattgtcctnctcttacactccacaccccctgctcttgtgctgaa

SEQ ID NO: 44486 - DNA, 71 bp, chicken (Gallus Gallus)
  misc_feature (36): n=a or g
acctgcaaacaacagccagagcacatcttcatgttntattttatattggcatgccacagacttgctttctt

SEQ ID NO: 44487 - DNA, 71 bp, chicken (Gallus Gallus)
  misc_feature (36): n=c or t
agcctggttggattctattcctcatccagaaaacantgaaagccatcccaaaagccatctctctggtatgc

SEQ ID NO: 44488 - DNA, 71 bp, chicken (Gallus Gallus)
  misc_feature (36): n=a or g
tgagcaaagattcagatgtgaagaacagtgctcaanactttaaggatggatttggaaataatatgaattag

SEQ ID NO: 44489 - DNA, 71 bp, chicken (Gallus Gallus)
  misc_feature (36): n=c or t
tgcagcacccttgaaaggctgtgctgtaactaatanaagttgagtttgttttgtgtgagtgagcccaggat

SEQ ID NO: 44490 - DNA, 71 bp, chicken (Gallus Gallus)
  misc_feature (36): n=a or c
ttttgtctagcctcttatcacacatggggccaaagnaaacctcctgcaactcctgcatctctctcattcat

SEQ ID NO: 44491 - DNA, 71 bp, chicken (Gallus Gallus)
  misc_feature (36): n=a or g
atgggggaaatgaggcctgacctcagctacaccaangactgagggctgtgaacaggagaggatctaggact

SEQ ID NO: 44492 - DNA, 71 bp, chicken (Gallus Gallus)
  misc_feature (36): n=c or t
agggcagagctgcctgattctgatactctgcttccngagtcctcagggttctgctgttcagctgtctcagt

SEQ ID NO: 44493 - DNA, 71 bp, chicken (Gallus Gallus)
  misc_feature (36): n=a or g
aaaagctgaacctcatgatttgtgcctatcaactcngttccacttacatcagctaaggcaaacagttttgt

SEQ ID NO: 44494 - DNA, 71 bp, chicken (Gallus Gallus)
  misc_feature (36): n=a or g
ttgaagacagatgcccaaagcataataaacagaccnaaattacaaaactattgctatcacagtttacaagt

SEQ ID NO: 44495 - DNA, 71 bp, chicken (Gallus Gallus)
  misc_feature (36): n=a or c
tgaactggactcaaggaaaaagtatatttgaaggtntctggtgctcagggagatgcatgtaatatttaaaa

SEQ ID NO: 44496 - DNA, 71 bp, chicken (Gallus Gallus)
  misc_feature (36): n=c or t
tcaatatcataagaagagaccagaacaacaattttngcttgtgtaaattgaggatgcctgtgtatttttca

SEQ ID NO: 44497 - DNA, 71 bp, chicken (Gallus Gallus)
  misc_feature (36): n=a or g
aaggtagagaatgtgtggcccaaaaaacagatatcncttattggaacagtgctcacaacctcacagtcttg

SEQ ID NO: 44498 - DNA, 71 bp, chicken (Gallus Gallus)
  misc_feature (36): n=c or t
agtaacagtctagaaattagaagaaagtttataacntcccaaggagttaagtacaaccacatccaaagcgt

SEQ ID NO: 44499 - DNA, 71 bp, chicken (Gallus Gallus)
  misc_feature (36): n=c or t
accaccatcttccctaactcaaactaatgcacctanttttagtcaaagactgagaatgagaaatactagat

SEQ ID NO: 44500 - DNA, 71 bp, chicken (Gallus Gallus)
  misc_feature (36): n=a or g
tctctgctgtttcttagaaggtactggagtattaanaatgagagagcaacgtcattccaccatgtttggtt

SEQ ID NO: 44501 - DNA, 71 bp, chicken (Gallus Gallus)
  misc_feature (36): n=c or t
aagtttttctacagctttctcctgattgttatatcnaaattctaatgggtgtctggaatcattttatggtg

SEQ ID NO: 44502 - DNA, 71 bp, chicken (Gallus Gallus)
  misc_feature (36): n=c or t
aaatcacaacttggttggaagtccaggttagtatangaagccaggagtactattaatgtgttagcaacagt

SEQ ID NO: 44503 - DNA, 71 bp, chicken (Gallus Gallus)
  misc_feature (36): n=a or g
taattctctgactcctgttttctggtggaatgttcnaatacgctaagaatatgatgcaccttacaaaatct

SEQ ID NO: 44504 - DNA, 71 bp, chicken (Gallus Gallus)
  misc_feature (36): n=c or t
caaataggatgtgtccaataatgatgaccccactgnccctcaggtcttctcaacagctttctaaataatcc

SEQ ID NO: 44505 - DNA, 71 bp, chicken (Gallus Gallus)
  misc_feature (36): n=a or g
gtattgaagacaaaatttgtccccatcttgaaggangggtttctaagtgcagtcattctcttcctctttgt

SEQ ID NO: 44506 - DNA, 71 bp, chicken (Gallus Gallus)
  misc_feature (36): n=c or t
agttataagctgctttctgtaaggataatttaccantgatcagtagcatcttgcctcagaaaacctgtatc

SEQ ID NO: 44507 - DNA, 71 bp, chicken (Gallus Gallus)
  misc_feature (36): n=g or t
tgtttgttactcaaacactgtggtatcttcacatgngaaaaccaggcagggaactcgattagagacaggct

SEQ ID NO: 44508 - DNA, 71 bp, chicken (Gallus Gallus)
  misc_feature (36): n=a or g
ttgtgcccccagaaaacacagtaaaggcaaaatggntcttaaattaggattgagagtctgatgttccccca

SEQ ID NO: 44509 - DNA, 71 bp, chicken (Gallus Gallus)
  misc_feature (36): n=a or g
ccagagtcttttgagaaacttttcttgcatttaatngtttggaggaacgacaatttgcagtattactatac

SEQ ID NO: 44510 - DNA, 71 bp, chicken (Gallus Gallus)
  misc_feature (36): n=c or t
ggtttgatttctgctgcaccacaaatgacagctccngagttaatccatctgcaaaatatggcaaatgatac

SEQ ID NO: 44511 - DNA, 71 bp, chicken (Gallus Gallus)
  misc_feature (36): n=a or g
tatttcagtgatttctctcccctctgtagccatgangatacatgtcataacagagatcaactatcattgca

SEQ ID NO: 44512 - DNA, 71 bp, chicken (Gallus Gallus)
  misc_feature (36): n=g or t
ctgctctttgtcccttttgtcagatttcattgtaanctttttatagttgtctcctagggttttgttgtctg

SEQ ID NO: 44513 - DNA, 71 bp, chicken (Gallus Gallus)
  misc_feature (36): n=c or t
aaaagattgtctacatttctaagaaatatgagcatnttgttccagggagggtctctgctgccttaactaat

SEQ ID NO: 44514 - DNA, 71 bp, chicken (Gallus Gallus)
  misc_feature (36): n=a or g
ctctgtggatttttgttgcctttgataaagatgctntagtgtttcttaagagcttccatatcagctgtaag

SEQ ID NO: 44515 - DNA, 71 bp, chicken (Gallus Gallus)
  misc_feature (36): n=c or t
caggaatgaagaccatgtgagtttgtgaccatgtgnctgaacaaagtggggacaggtttagtatactacac

SEQ ID NO: 44516 - DNA, 71 bp, chicken (Gallus Gallus)
  misc_feature (36): n=a or g
cgctgttatctgcacagcaaaaatggatgtgtttcncaggttacacagatttcaaaatttacagcacttgc

SEQ ID NO: 44517 - DNA, 71 bp, chicken (Gallus Gallus)
  misc_feature (36): n=c or t
ctgttttcccactgaggagacaatgacaagttgttngggcaacacttcctgttatgtgcatagccttcctc

SEQ ID NO: 44518 - DNA, 71 bp, chicken (Gallus Gallus)
  misc_feature (36): n=c or t
tggtttctgtgagaggagaggcagatggataacaangtgggcactcctaaagcaaagcatttccaaggcaa

SEQ ID NO: 44519 - DNA, 71 bp, chicken (Gallus Gallus)
  misc_feature (36): n=c or t
tatatcaaaattcagaatggcttcaaatatttgacngtcttgattagaaacatctataaaattcagctaag

SEQ ID NO: 44520 - DNA, 71 bp, chicken (Gallus Gallus)
  misc_feature (36): n=c or t
gtttccttttctgaaaggaagtatcatccaatttgngtacagattctctccccactccaaaaaggaagtat

SEQ ID NO: 44521 - DNA, 71 bp, chicken (Gallus Gallus)
  misc_feature (36): n=a or g
gacagccatttcagagtcaggctacaatgtgacaanctgagggttttagctcaaagtgcctgtctgcatcg

SEQ ID NO: 44522 - DNA, 71 bp, chicken (Gallus Gallus)
  misc_feature (36): n=c or t
agtcagactggcatctagtgggattctgaacctccntttcttgctgatcaacaacttttggtagctaaaaa

SEQ ID NO: 44523 - DNA, 71 bp, chicken (Gallus Gallus)
  misc_feature (36): n=a or g
ggccctctccatgcctgaatagctttttattccctnaataaatccactgatcaattccaaccacatgtaaa

SEQ ID NO: 44524 - DNA, 71 bp, chicken (Gallus Gallus)
  misc_feature (36): n=g or t
ctacatttgctgttttgggtgcttacaacagtgctnctgtcttctgtcaccattaacccagaagagtggtc

SEQ ID NO: 44525 - DNA, 71 bp, chicken (Gallus Gallus)
  misc_feature (36): n=c or t
cagggtgggagtggtgtgctgctgtataccctcttnagctcgtggtagctgtctctcatcactaccatgct

SEQ ID NO: 44526 - DNA, 71 bp, chicken (Gallus Gallus)
  misc_feature (36): n=a or g
atgagtatctctgaaagcagcctgcaaattcatagngaagctgtttagaaattggcaagaagcagcactaa

SEQ ID NO: 44527 - DNA, 71 bp, chicken (Gallus Gallus)
  misc_feature (36): n=a or g
tcctgctctcaggctccagctcatgcacattacccntagcgcgcttcacattcctggtcggtatccagtcg

SEQ ID NO: 44528 - DNA, 71 bp, chicken (Gallus Gallus)
  misc_feature (36): n=c or t
caggcactgagaatggcagaaaactcaggtatttgngctcttggctacacgtatttatgcccatgtatatg

SEQ ID NO: 44529 - DNA, 71 bp, chicken (Gallus Gallus)
  misc_feature (36): n=c or t
aagcattcagagagatttacttgtgtcaccacttgntccttaaaggaaataaggtctgcaagaaatatgac

SEQ ID NO: 44530 - DNA, 71 bp, chicken (Gallus Gallus)
  misc_feature (36): n=g or t
gctgctgctaactcgaatggcacatctaatgcaaangctggcgaggattagcatgcaaaatgcttcaggat

SEQ ID NO: 44531 - DNA, 71 bp, chicken (Gallus Gallus)
  misc_feature (36): n=c or t
tggagacactgtgttctcattagtgtgcagcaattntgagtttgtactgagatgtagcctaatagtatcct

SEQ ID NO: 44532 - DNA, 71 bp, chicken (Gallus Gallus)
  misc_feature (36): n=c or t
agaattctacttaaattaatttttctgtacccttgncaactgaaaatgtcaatcttttgacccaaaagctt

SEQ ID NO: 44533 - DNA, 71 bp, chicken (Gallus Gallus)
  misc_feature (36): n=a or g
agagctcatgatgtatgacatttcacttgaagaatnatttgctcttaatattacattcaacttttttctag

SEQ ID NO: 44534 - DNA, 71 bp, chicken (Gallus Gallus)
  misc_feature (36): n=a or g
gcaaaggtcttctcttaaaagaaagttacagaaacnaaaaggttgtaatcacagatcttctgtttctaaca

SEQ ID NO: 44535 - DNA, 71 bp, chicken (Gallus Gallus)
  misc_feature (36): n=c or t
ttcccatcaggcataacaacctaattttgatggttntgaggacagtatcattagctatccattacattatt

SEQ ID NO: 44536 - DNA, 71 bp, chicken (Gallus Gallus)
  misc_feature (36): n=a or g
aataaccaaggaaaaatatcttgccacaagccagcnaaaccagcatcctctctccttaactagctcatttt

SEQ ID NO: 44537 - DNA, 71 bp, chicken (Gallus Gallus)
  misc_feature (36): n=c or t
gttggatgagatcaaataggcctgcagagcaaatanagtgcatttcacttaacatgtttgtagcattatct

SEQ ID NO: 44538 - DNA, 71 bp, chicken (Gallus Gallus)
  misc_feature (36): n=c or t
gtcagtagagactaggtagagaccatgactaaggancatgactaaagaaaacctttgccaaacatgttaca

SEQ ID NO: 44539 - DNA, 71 bp, chicken (Gallus Gallus)
  misc_feature (36): n=c or t
atgcattgatcattttaattactcatgggattactnaggcaaacagtaaggcacgtgcagaattttgtagt

SEQ ID NO: 44540 - DNA, 71 bp, chicken (Gallus Gallus)
  misc_feature (36): n=c or t
tacttcacatccaatggccttgtaaccaaagcactngaacatgctttcaagttggagcatattatggatct

SEQ ID NO: 44541 - DNA, 71 bp, chicken (Gallus Gallus)
  misc_feature (36): n=c or t
aagttttgttaataactgtgcttggatcacctaagntttaaagctgtagttttctcaaggccagcaaacgc

SEQ ID NO: 44542 - DNA, 71 bp, chicken (Gallus Gallus)
  misc_feature (36): n=a or g
tttacaggagctctctctttcttctgtggactctgntgcagggtacgttgtttattccagtgttagacttt

SEQ ID NO: 44543 - DNA, 71 bp, chicken (Gallus Gallus)
  misc_feature (36): n=c or t
ctttttgtttcaggtgactctgaatatcacagtttngaacaagaactgggcgtgcaatgctctgccaatga

SEQ ID NO: 44544 - DNA, 71 bp, chicken (Gallus Gallus)
  misc_feature (36): n=a or g
aacaaaattgccatttgatattaagcttttcctaantaaccggtgtatggttccttctatgtgaatggata

SEQ ID NO: 44545 - DNA, 71 bp, chicken (Gallus Gallus)
  misc_feature (36): n=a or g
acttggtgctccctcctataggcatcttgtttacanttcaacagttttaaattggtaactattatggaaat

SEQ ID NO: 44546 - DNA, 71 bp, chicken (Gallus Gallus)
  misc_feature (36): n=a or c
aaaaagtgtttgatgctacagaagaagaactgatgntctcactgttagatgcacagcagaaagtatatatt

SEQ ID NO: 44547 - DNA, 71 bp, chicken (Gallus Gallus)
  misc_feature (36): n=a or g
tcgtcaggatcgtattttatcattgcgtacaggagngttaatcccttagcagatacattgtgcaccgaagg

SEQ ID NO: 44548 - DNA, 71 bp, chicken (Gallus Gallus)
  misc_feature (36): n=a or g
ctacagctgcatttttggatggaaagggaaggttgngttattaaacagaaatctatagttgtcctttcctc

SEQ ID NO: 44549 - DNA, 71 bp, chicken (Gallus Gallus)
  misc_feature (36): n=a or c
gaagacttgatggagctggctctcccacgtcttacngagcttgttacagtgtatgaattcctgttgatgaa

SEQ ID NO: 44550 - DNA, 71 bp, chicken (Gallus Gallus)
  misc_feature (36): n=c or t
ggattttggtttctttataaagttctgcggctgtantgactcagtggtaccagtatgaccacagagcagcc

SEQ ID NO: 44551 - DNA, 71 bp, chicken (Gallus Gallus)
  misc_feature (36): n=a or g
tttttcttcgctagcctacatggcttgctgaagtcnaataagggggaaagcctgcccagctggcagtgcgt

SEQ ID NO: 44552 - DNA, 71 bp, chicken (Gallus Gallus)
  misc_feature (36): n=a or c
gagttgagtgtgttctactgaagagcgtctctgcangtctcctggcggtggagagcgctgtctcagccctg

SEQ ID NO: 44553 - DNA, 71 bp, chicken (Gallus Gallus)
  misc_feature (36): n=c or t
agtggtgaacttgaaacccatttcttcagttgatcncaaatttgttatgtctctaatgaagtaagcgtagg

SEQ ID NO: 44554 - DNA, 71 bp, chicken (Gallus Gallus)
  misc_feature (36): n=a or g
gttaaccccttcaggctagatttgaaaaaaagaatncttcaacagaatgaaaaaagtgagaggtaacagaa

SEQ ID NO: 44555 - DNA, 71 bp, chicken (Gallus Gallus)
  misc_feature (36): n=c or t
gccacacacctgtcagatttcttgtgtgcttgcttnggctttgacaaagagcgatctctgatgtgataaca

SEQ ID NO: 44556 - DNA, 71 bp, chicken (Gallus Gallus)
  misc_feature (36): n=c or t
agaaggcatgcttcaacatttttgccttctaggcanctgtcagaatgcacctgaatgagagaattaactta

SEQ ID NO: 44557 - DNA, 71 bp, chicken (Gallus Gallus)
  misc_feature (36): n=a or g
ttgatttaagtattagtgtttctataccttgcttgncattccttatttctacctaaagttcatacattgta

SEQ ID NO: 44558 - DNA, 71 bp, chicken (Gallus Gallus)
  misc_feature (36): n=c or t
ccatgcctatgtaaaaatctctttgcagttgttagnattctcagtagtttgaatctattagaaaaccaaca

SEQ ID NO: 44559 - DNA, 71 bp, chicken (Gallus Gallus)
  misc_feature (36): n=a or g
gaatacagaacttgggttaggcaagcagtctaacanatctgaaagaaaacttcagtgtagaatttccttta

SEQ ID NO: 44560 - DNA, 71 bp, chicken (Gallus Gallus)
  misc_feature (36): n=a or c
aagcatgtcgaaaggattctttatccaactgttgantttcacaattacaagtcagttgcaccaagctccca

SEQ ID NO: 44561 - DNA, 71 bp, chicken (Gallus Gallus)
  misc_feature (36): n=a or g
aggcaaattgaaaacactaagttttcctatggattntttaaagaatcatagtatgactaaggttggaaaag

SEQ ID NO: 44562 - DNA, 71 bp, chicken (Gallus Gallus)
  misc_feature (36): n=c or t
ataagcacatgggctgtctgagggacagaggactcncagatgtctcatggcattattactttcttatcatt

SEQ ID NO: 44563 - DNA, 71 bp, chicken (Gallus Gallus)
  misc_feature (36): n=a or g
ctcagtaggaggttgtcaacactccttccttcgacngagctgtctttgtggctctgggaaacaaacatgcc

SEQ ID NO: 44564 - DNA, 71 bp, chicken (Gallus Gallus)
  misc_feature (36): n=g or t
taaggagtcaagattcctgactggatcttaaaaatnaagtaacttgaaaagagacatcttgagaagttcag

SEQ ID NO: 44565 - DNA, 71 bp, chicken (Gallus Gallus)
  misc_feature (36): n=a or g
cttttattgcagagtataaatgtttcctcccgctcncaagctcttcttgtaaggaaagaaaacaaaaccaa

SEQ ID NO: 44566 - DNA, 71 bp, chicken (Gallus Gallus)
  misc_feature (36): n=c or t
tcctgtgaaaggaaagccctggtaatataatactanatggtgcagtaagagcaaactccattcagagcttt

SEQ ID NO: 44567 - DNA, 71 bp, chicken (Gallus Gallus)
  misc_feature (36): n=c or t
ggcactcagtcggattgtttttttatatctgggtantgatatgttatcatacaataaaatcatagaatcag

SEQ ID NO: 44568 - DNA, 71 bp, chicken (Gallus Gallus)
  misc_feature (36): n=c or t
atgtgaggctggatcactgatagggagacattcagnggtggagcccactttggctcttacactttttctta

SEQ ID NO: 44569 - DNA, 71 bp, chicken (Gallus Gallus)
  misc_feature (36): n=c or t
catactggttctaatgatacctttcccctaccacangtatgtttgagcacaggcaacacaacttcattaag

SEQ ID NO: 44570 - DNA, 71 bp, chicken (Gallus Gallus)
  misc_feature (36): n=a or g
gtttaccattctagcccacaaaaatagcacctacanctgattatcagaacatgggatatgctcagaaggta

SEQ ID NO: 44571 - DNA, 71 bp, chicken (Gallus Gallus)
  misc_feature (36): n=c or t
cattgccacatgtgcccggggagtcaagtagtgaangtgctcagcatgcctaaacccagcaaagtaacctc

SEQ ID NO: 44572 - DNA, 71 bp, chicken (Gallus Gallus)
  misc_feature (36): n=a or g
ctctgatgctatctgaacacttcttgcaaaatgganctagcaaatacacatcaaataatgtcagatattct

SEQ ID NO: 44573 - DNA, 71 bp, chicken (Gallus Gallus)
  misc_feature (36): n=c or t
actcttgacgatcatatctactaaatgcttctcagnctttctttcacatctaagttgacatcctgtaataa

SEQ ID NO: 44574 - DNA, 71 bp, chicken (Gallus Gallus)
  misc_feature (36): n=c or t
gtaaacaacaacttagcaaagaacaagacatgaggngtataccatgattactatggaacgctatcagtccc

SEQ ID NO: 44575 - DNA, 71 bp, chicken (Gallus Gallus)
  misc_feature (36): n=a or c
cagcaatatctcttatcagaacttcttgcattgtgncaaaatgtttatagagacattctgtagagacagaa

SEQ ID NO: 44576 - DNA, 71 bp, chicken (Gallus Gallus)
  misc_feature (36): n=c or t
gttgaagggaggtgcccccagcttacccagcagcangctggctttctataggcttctgcagtaaaggtcgc

SEQ ID NO: 44577 - DNA, 71 bp, chicken (Gallus Gallus)
  misc_feature (36): n=c or t
tgagctgcttgtcctggaggagcaaatcagccctgncaccagtacatacatcagaatatttttaatatacg

SEQ ID NO: 44578 - DNA, 71 bp, chicken (Gallus Gallus)
  misc_feature (36): n=c or t
ggtcgaaaataaaaacctctgtcatgcaagcacggnctcagcaacatgcctaagatggtcagaaaatacca

SEQ ID NO: 44579 - DNA, 71 bp, chicken (Gallus Gallus)
  misc_feature (36): n=a or g
atgcaccacagccatgcctacagaagccctgctagntgtgttcaagctgacatccatccaccagtgaaggg

SEQ ID NO: 44580 - DNA, 71 bp, chicken (Gallus Gallus)
  misc_feature (36): n=c or t
atatggcctatcctactgagaacaaggcaacttttnacttgttttgtcccgtttctttgaagtacttaata

SEQ ID NO: 44581 - DNA, 71 bp, chicken (Gallus Gallus)
  misc_feature (36): n=c or t
atctcagatcttagaagaaaacctaaactctgcaantgataaaaggaaacataagcacgtgaacaaacaat

SEQ ID NO: 44582 - DNA, 71 bp, chicken (Gallus Gallus)
  misc_feature (36): n=a or g
gtgaaccatgctgtttatgggtggatgcttggcacngacttgtcttgaaagaaaacaaacacagatgttat

SEQ ID NO: 44583 - DNA, 71 bp, chicken (Gallus Gallus)
  misc_feature (36): n=c or t
ttaatacgttgctatggtgaattacgtgaagaagcnaaagcttcaacaccatagttgggttataataaaat

SEQ ID NO: 44584 - DNA, 71 bp, chicken (Gallus Gallus)
  misc_feature (36): n=c or t
caatctcagttttatagtctaaatattttcttggancagaagcgttttggaacaaaaattcaggcatattt

SEQ ID NO: 44585 - DNA, 71 bp, chicken (Gallus Gallus)
  misc_feature (36): n=c or t
ctgaattacaacatagccagcaattttggtgattcngagagtgcatctgtgaggcaaacatcgagcccaag

SEQ ID NO: 44586 - DNA, 71 bp, chicken (Gallus Gallus)
  misc_feature (36): n=a or g
gcctagaaataaaatctgacccaagtcctcttgcanaaagaatgaagaaactcatttgttttgaaggtttt

SEQ ID NO: 44587 - DNA, 71 bp, chicken (Gallus Gallus)
  misc_feature (36): n=a or g
ctgattgccttcaaacaaagggacagggggtataanggagctactctggaaaagtctggagtaaagaatgg

SEQ ID NO: 44588 - DNA, 71 bp, chicken (Gallus Gallus)
  misc_feature (36): n=c or t
cctatgaggacataaggcacattgggcatgcagacnttcagctcaggtacccactcctcctggacgttgtg

SEQ ID NO: 44589 - DNA, 71 bp, chicken (Gallus Gallus)
  misc_feature (36): n=c or t
gtggaggtaaaggagtgctatgaatgagaattcacnccctctccattattcctccaaacagtgcatctgtg

SEQ ID NO: 44590 - DNA, 71 bp, chicken (Gallus Gallus)
  misc_feature (36): n=c or t
ttttttttggtgttaaattgagatttcccaatggtntaactgagttattttgtgtctgttctgcagggggc

SEQ ID NO: 44591 - DNA, 71 bp, chicken (Gallus Gallus)
  misc_feature (36): n=a or g
agttacagaactacgtggagggcaatgaaagagggntattctgtcacctagtcacttctgcttttgtgaag

SEQ ID NO: 44592 - DNA, 71 bp, chicken (Gallus Gallus)
  misc_feature (36): n=c or t
atgattgtcttttgctccactccattgtgaccgttngttttgcacgcctttacacgtttccaagcaagcga

SEQ ID NO: 44593 - DNA, 71 bp, chicken (Gallus Gallus)
  misc_feature (36): n=a or g
ttgttcacgttttcagacatgtaaatcatgtccccntcctcagaaagcaccataacaaatccatcaagagc

SEQ ID NO: 44594 - DNA, 71 bp, chicken (Gallus Gallus)
  misc_feature (36): n=c or t
ttaaaagcactttgctttggcctgtagatttccacngtcaaatttactatcagcttcggaaggagcattac

SEQ ID NO: 44595 - DNA, 71 bp, chicken (Gallus Gallus)
  misc_feature (36): n=a or g
ccgaaaactgatgatttttagcagaagcgacttaanacagaaaactacagaacagttacatttggggagaa

SEQ ID NO: 44596 - DNA, 71 bp, chicken (Gallus Gallus)
  misc_feature (36): n=a or g
gagagtcggagaaagaggtattaaaacagcttcacnttagtcctgaggtgtccaagtacaatttggagctg

SEQ ID NO: 44597 - DNA, 71 bp, chicken (Gallus Gallus)
  misc_feature (36): n=c or t
ggaaacaaataccccaagacacagatgatcagttcnagacaatacttgagcttatctgttttacccaaaca

SEQ ID NO: 44598 - DNA, 71 bp, chicken (Gallus Gallus)
  misc_feature (36): n=a or g
gaggaattcattgcagtcagctcaaggatttgaaantgtaacagcgacacacccaattgaaaacaattttc

SEQ ID NO: 44599 - DNA, 71 bp, chicken (Gallus Gallus)
  misc_feature (36): n=c or t
ttatcccctcagcactctgggtttggttatcacttngcatcacttcttgagttttctgcactgatggctgt

SEQ ID NO: 44600 - DNA, 71 bp, chicken (Gallus Gallus)
  misc_feature (36): n=c or t
aatgtgtctgaagggagaggcacagcagtgccatgngttcttgctctgcttaagcatgtgaagatgtgcat

SEQ ID NO: 44601 - DNA, 71 bp, chicken (Gallus Gallus)
  misc_feature (36): n=a or g
atttaagttcctattgtctctgattatccagacacnctggactgtggctacctctatcccagaggcagtga

SEQ ID NO: 44602 - DNA, 71 bp, chicken (Gallus Gallus)
  misc_feature (36): n=g or t
gctcgatctcagtatgagcttggccatagaaatggncatcatgtcctgaatattacagctattctgtgagc

SEQ ID NO: 44603 - DNA, 71 bp, chicken (Gallus Gallus)
  misc_feature (36): n=a or g
tatgcaaaacaagatgcagatggctatccaagtagngacaacctattagctagaggatctgaagaccagat

SEQ ID NO: 44604 - DNA, 71 bp, chicken (Gallus Gallus)
  misc_feature (36): n=c or t
tacccacttacctgctcacgtccccatctgcagcantgtgcagtatctcatggacaaaaggtgctaggcag

SEQ ID NO: 44605 - DNA, 71 bp, chicken (Gallus Gallus)
  misc_feature (36): n=a or c
tatttccaatttctacttccaaatccaatttacaanaacaaagccctgaggagggcagagtgagcggggcc

SEQ ID NO: 44606 - DNA, 71 bp, chicken (Gallus Gallus)
  misc_feature (36): n=a or g
gcccaccagaaacactgcaaatcagtcacatctaanttgcctaatctgaaggacaggtgatggaaactaca

SEQ ID NO: 44607 - DNA, 71 bp, chicken (Gallus Gallus)
  misc_feature (36): n=c or t
gagaatatttgggagtgcagtgagatgagcagaaangctccatgtgtaccagcccaaatcctgcatgcttc

SEQ ID NO: 44608 - DNA, 71 bp, chicken (Gallus Gallus)
  misc_feature (36): n=c or t
cactctgtagactgatgctgaataatctgcactcangtctgcactttaacttcctggaaactgttaaaaaa

SEQ ID NO: 44609 - DNA, 71 bp, chicken (Gallus Gallus)
  misc_feature (36): n=c or t
atccgctcatccacggcctttctgatacgaatcttntccaatgcatctctgaaacagaaggaactgtttta

SEQ ID NO: 44610 - DNA, 71 bp, chicken (Gallus Gallus)
  misc_feature (36): n=a or g
attgaattgcaattttgggaggagttttcataagcngggcatgagtctgtttgcaaagcagtaggcctgat

SEQ ID NO: 44611 - DNA, 71 bp, chicken (Gallus Gallus)
  misc_feature (36): n=c or t
gaggagatgaggcagtggaagcactaagctagaagnaacacgtatttttagatagtagagtgtggactttc

SEQ ID NO: 44612 - DNA, 71 bp, chicken (Gallus Gallus)
  misc_feature (36): n=c or t
ggttcagtgttctagctatagactgcagtagtgaangtgagcatagagatggagaaaatcaaaatgggaga

SEQ ID NO: 44613 - DNA, 71 bp, chicken (Gallus Gallus)
  misc_feature (36): n=c or t
gtttaagtttaccctctgtttggaaagtacttaagnataggcttaactttgagcagacgtttaagtcccct

SEQ ID NO: 44614 - DNA, 71 bp, chicken (Gallus Gallus)
  misc_feature (36): n=c or t
ggactgtctctaaagctttgcacagacattataaancatgagtgcaataagccaaagctgcaggggcagcc

SEQ ID NO: 44615 - DNA, 71 bp, chicken (Gallus Gallus)
  misc_feature (36): n=g or t
aaaagcattagttcctggcatctgggtcgaattcanggctggaaattgtgtcaatctatgtgtttgtaagc

SEQ ID NO: 44616 - DNA, 71 bp, chicken (Gallus Gallus)
  misc_feature (36): n=a or g
atacactctgtgcatgcactgaggaaaggtggtgtncgtcagcaggcagtgacatctcccaaacatgaggg

SEQ ID NO: 44617 - DNA, 71 bp, chicken (Gallus Gallus)
  misc_feature (36): n=c or t
tgtttgaaagctgatgggtataatttggacaacttnatacaaagaggttgagcacaaggaagaatctcaca

SEQ ID NO: 44618 - DNA, 71 bp, chicken (Gallus Gallus)
  misc_feature (36): n=a or g
tttatcttcatctgctgagattcctggtagctaacntgtattttactctggaaggtgccatgctccttctc

SEQ ID NO: 44619 - DNA, 71 bp, chicken (Gallus Gallus)
  misc_feature (36): n=a or c
gttgcatatccagaggaaggaaatgtaggaaccctnaaaaaataaaagtgcttggtaggaagaaaacagta

SEQ ID NO: 44620 - DNA, 71 bp, chicken (Gallus Gallus)
  misc_feature (36): n=a or g
cagcaggaggttcaataacaaagtcacacagaagtntactgtcactggctttactattagccttgcagagc

SEQ ID NO: 44621 - DNA, 71 bp, chicken (Gallus Gallus)
  misc_feature (36): n=c or t
gcatcaccgcagagcagagcggctttccaggatccntgtgctcaacactgggtgtgcctacttatatttgg

SEQ ID NO: 44622 - DNA, 71 bp, chicken (Gallus Gallus)
  misc_feature (36): n=a or g
aaaaaaaaaaagaaaaagtaatttttctgacatcantcatacaattaccatttgcatatgttggagggaga

SEQ ID NO: 44623 - DNA, 71 bp, chicken (Gallus Gallus)
  misc_feature (36): n=a or g
ttttcctttagcttggtgtgctgagctgaggtagancagaggggcagtgcagaagtgagtcctgcgctgtg

SEQ ID NO: 44624 - DNA, 71 bp, chicken (Gallus Gallus)
  misc_feature (36): n=a or g
tatagaaacagccttacagtcagtactcctgtacanccttcttttgatgcgtgatgtgagtgaataccaat

SEQ ID NO: 44625 - DNA, 71 bp, chicken (Gallus Gallus)
  misc_feature (36): n=a or c
atctcagtgctgtcggggttactcctctgaggcttntttcatcaattggtgattggggaaagctgtagcac

SEQ ID NO: 44626 - DNA, 71 bp, chicken (Gallus Gallus)
  misc_feature (36): n=a or g
gtgtcaaattttgttctgttcagatgacagaaacancccatgacccagtttgatcactcaagacccatctt

SEQ ID NO: 44627 - DNA, 71 bp, chicken (Gallus Gallus)
  misc_feature (36): n=a or c
taggaagacttttaagccagcctgtctctgatttgntgattttactgtgggaagttaatctgcaaaacaat

SEQ ID NO: 44628 - DNA, 71 bp, chicken (Gallus Gallus)
  misc_feature (36): n=a or g
caggctgtgctgggtggtggaccagtgatggtgctnggacaatgcactcctgtgctgcacatcttgaacac

SEQ ID NO: 44629 - DNA, 71 bp, chicken (Gallus Gallus)
  misc_feature (36): n=c or t
catgagatgtaggcccctgcttatctcgccagagcngtgccacagcttcagtgctaatcttggatctgtgc

SEQ ID NO: 44630 - DNA, 71 bp, chicken (Gallus Gallus)
  misc_feature (36): n=c or t
atcaaaccatccattatttccatacatttttcttcncttgctacgttcagataaattacatacaaagccct

SEQ ID NO: 44631 - DNA, 71 bp, chicken (Gallus Gallus)
  misc_feature (36): n=c or t
ctatcaccagctccttattcaacctgaacaacttanggccattacctcccattctatcactagttcctaac

SEQ ID NO: 44632 - DNA, 71 bp, chicken (Gallus Gallus)
  misc_feature (36): n=c or t
ggctttatttgcaaactcactgggttttcttcattntcaatatctaaacagagtcaggttctgaagtaaaa

SEQ ID NO: 44633 - DNA, 71 bp, chicken (Gallus Gallus)
  misc_feature (36): n=a or c
aaggatgaacagtttggctgccagctcaaggcaaanaaagcaacaggaagatttggaggaggcggaataga

SEQ ID NO: 44634 - DNA, 71 bp, chicken (Gallus Gallus)
  misc_feature (36): n=c or t
cctaatgaacatgttttatgattcagcactgtaganaactgcaccgtctttttgctttcccattgcataat

SEQ ID NO: 44635 - DNA, 71 bp, chicken (Gallus Gallus)
  misc_feature (36): n=a or g
gatttttcaaatgctgttaagcaaacattccccttnctggtaaagaattcagtatcctgtgcagcagagac

SEQ ID NO: 44636 - DNA, 71 bp, chicken (Gallus Gallus)
  misc_feature (36): n=a or g
gtgccgaattatagtaggctgcctcaaggtgtgacncttactgtcactgcttatgtcaaggttgggaattg

SEQ ID NO: 44637 - DNA, 71 bp, chicken (Gallus Gallus)
  misc_feature (36): n=a or g
tgtgaggaaataactatgaaaaacaaccagagcacngcagctaataattgcaccatcgcagtatattgatt

SEQ ID NO: 44638 - DNA, 71 bp, chicken (Gallus Gallus)
  misc_feature (36): n=a or g
gcatggtttgctatcttttattttcctgcctattcntttgaagccaatatacagcattagaacatgtatag

SEQ ID NO: 44639 - DNA, 71 bp, chicken (Gallus Gallus)
  misc_feature (36): n=c or t
atgagctccattttctaagcctcccagcaaggctangctccagctttgctatcagcaccggtagcctattt

SEQ ID NO: 44640 - DNA, 71 bp, chicken (Gallus Gallus)
  misc_feature (36): n=a or c
agctattcttcagggcagtctttaacattaacatcnccttctctccccttttctgcctctcctcggataca

SEQ ID NO: 44641 - DNA, 71 bp, chicken (Gallus Gallus)
  misc_feature (36): n=c or t
tcagtataattatattactttgcatcatcctccttnctacctgtggtgcctgctaatatgatttctccgtg

SEQ ID NO: 44642 - DNA, 71 bp, chicken (Gallus Gallus)
  misc_feature (36): n=a or g
tcacgaagggctggggatgggaaaagcaatggtaantgctgccgtggtaagtgggccaggcgaggcaaggt

SEQ ID NO: 44643 - DNA, 71 bp, chicken (Gallus Gallus)
  misc_feature (36): n=c or t
ccggcataatttgctgtgtgggcaagccctcagtangccaagtgagctcactctgcctccccattaatgat

SEQ ID NO: 44644 - DNA, 71 bp, chicken (Gallus Gallus)
  misc_feature (36): n=a or g
gctgtgtcacagctacgtgtcgtacacgaggaaccnacatgtggtgtaggcgctgagttcgtcggcatccc

SEQ ID NO: 44645 - DNA, 71 bp, chicken (Gallus Gallus)
  misc_feature (36): n=g or t
gttggtcattggcaatgtgcctttccaataaagganctggtatggacatggcacccaggagcaaatccctt

SEQ ID NO: 44646 - DNA, 71 bp, chicken (Gallus Gallus)
  misc_feature (36): n=a or g
ccccaaatccacttttctcaaatcccgtgtccccanaaccattgagagccatccgagcttggcttcattcg

SEQ ID NO: 44647 - DNA, 71 bp, chicken (Gallus Gallus)
  misc_feature (36): n=a or g
atagaaattctacatatatggtacagaactgctccnaactgaactctaaaaatgtttaaggcaaacacagc

SEQ ID NO: 44648 - DNA, 71 bp, chicken (Gallus Gallus)
  misc_feature (36): n=a or g
gcagcacgtcctgaaggaagcggcactccaggctcntatttcttggtgtggagagactcggatcagctgct

SEQ ID NO: 44649 - DNA, 71 bp, chicken (Gallus Gallus)
  misc_feature (36): n=a or g
atagaggtttcttacaatgacctaaacagaacttcnatttctcatgcctgtaagcactctgcattttttat

SEQ ID NO: 44650 - DNA, 71 bp, chicken (Gallus Gallus)
  misc_feature (36): n=g or t
tcgctaataacttagcctttttctcagggtgctctncttccattagtggagcctgccctggggagctgctg

SEQ ID NO: 44651 - DNA, 71 bp, chicken (Gallus Gallus)
  misc_feature (36): n=a or g
aaatatctcctagggcagccaaatggacctggaggnagggtggtgaaaatgctggaagatctgcatcagaa

SEQ ID NO: 44652 - DNA, 71 bp, chicken (Gallus Gallus)
  misc_feature (36): n=c or t
acatgggttgtgtgcacccctcctacaaatatcacnattttctctccttggttcagccagaaatttccaga

SEQ ID NO: 44653 - DNA, 71 bp, chicken (Gallus Gallus)
  misc_feature (36): n=g or t
tgcatcaccgggaattgtaaccacactcctcccaangaggagctcagccctgagtccacagcacgcaaatc

SEQ ID NO: 44654 - DNA, 71 bp, chicken (Gallus Gallus)
  misc_feature (36): n=a or g
gggataggataactgggtagctgctgtgggatgccntgtatcacataggattatttatgtcactttaactg

SEQ ID NO: 44655 - DNA, 71 bp, chicken (Gallus Gallus)
  misc_feature (36): n=a or c
gaaaatatcattttatgacattcagtgttagagtantgctattggacagccacagtatacgccagtcccaa

SEQ ID NO: 44656 - DNA, 71 bp, chicken (Gallus Gallus)
  misc_feature (36): n=a or g
tggttttgaaactcaaaaggcaaaagtgggatggcngggacgttgcagctgagttggttttccatttctct

SEQ ID NO: 44657 - DNA, 71 bp, chicken (Gallus Gallus)
  misc_feature (36): n=a or g
ctttcacctgcaatgcagcattatctgtgaatgatntgcctcctgcttgtccaggatattgtagttagatg

SEQ ID NO: 44658 - DNA, 71 bp, chicken (Gallus Gallus)
  misc_feature (36): n=g or t
acttggtggacgttgagatatccgaggagccagggncaggctcgtggatgtggttagtgctgttcagcaag

SEQ ID NO: 44659 - DNA, 71 bp, chicken (Gallus Gallus)
  misc_feature (36): n=a or g
gtcaggcaagacatttccttattcccagtggagatnttatttgtgccttctaaacaccaaagctattacaa

SEQ ID NO: 44660 - DNA, 71 bp, chicken (Gallus Gallus)
  misc_feature (36): n=a or c
gacaacatcaaattcccaaataggaatgagctctgnacataaacagaagttggggggacacaaatacatct

SEQ ID NO: 44661 - DNA, 71 bp, chicken (Gallus Gallus)
  misc_feature (36): n=a or g
caggaatgtacactcagtatataggtgaagtatatntgtaatattttgtcatacacgttgaaagaatatcc

SEQ ID NO: 44662 - DNA, 71 bp, chicken (Gallus Gallus)
  misc_feature (36): n=c or t
gtattctgatacatttgtcaagtatgcagtgattgntctttaaaaacctacctgacttcaattaactaaag

SEQ ID NO: 44663 - DNA, 71 bp, chicken (Gallus Gallus)
  misc_feature (36): n=c or t
aaaagtccgagagactgttttacacgtcttcttttncagctatagagacaagttctacatccaatgctcat

SEQ ID NO: 44664 - DNA, 71 bp, chicken (Gallus Gallus)
  misc_feature (36): n=c or t
tctaagaggtttatgaaacaactgagttctctcccntaccccagaggtaatcctttgccttaaggtttctt

SEQ ID NO: 44665 - DNA, 71 bp, chicken (Gallus Gallus)
  misc_feature (36): n=c or t
gttcctaagaaattcatggttttcacctcaaaagcnacttagatttcagatagaattttaagtaacataag

SEQ ID NO: 44666 - DNA, 71 bp, chicken (Gallus Gallus)
  misc_feature (36): n=a or g
gctcacagcaacgatgtggtcattatattaacaacngcatgggggccgctgggctcaggttctattcagca

SEQ ID NO: 44667 - DNA, 71 bp, chicken (Gallus Gallus)
  misc_feature (36): n=c or t
cagaatgtgaccaatacttttgatgaaataacaatnggtgttcaatacagttattctcaatgaagacactg

SEQ ID NO: 44668 - DNA, 71 bp, chicken (Gallus Gallus)
  misc_feature (36): n=c or t
ttccctactcactagaaaacagcacaagaaattgangccctaggccctccagaaaggatgtaaaacacagc

SEQ ID NO: 44669 - DNA, 71 bp, chicken (Gallus Gallus)
  misc_feature (36): n=g or t
gaagggtccttgtattttttagagcccagagcaggngtcatctatgcctgctttccataagaaaagctcaa

SEQ ID NO: 44670 - DNA, 71 bp, chicken (Gallus Gallus)
  misc_feature (36): n=a or g
actttcataccattatccaaatatataaaaagcctngtaaatagcagaactttctttatctaattctggtc

SEQ ID NO: 44671 - DNA, 71 bp, chicken (Gallus Gallus)
  misc_feature (36): n=c or t
gcctgatgattaccaaaggccaaatgtaagacagtncttcagagttgagaaagacagttaacactctgcgg

SEQ ID NO: 44672 - DNA, 71 bp, chicken (Gallus Gallus)
  misc_feature (36): n=a or g
attttcttttcttcgtttatcagtgctgcatccagncctagtacgtttatcattcccttttcattttctca

SEQ ID NO: 44673 - DNA, 71 bp, chicken (Gallus Gallus)
  misc_feature (36): n=c or t
tcaacttgcatgcttatgtaaacccagaaaccaaangaaagctgtataaatcttaagaaacaaaacctgca

SEQ ID NO: 44674 - DNA, 71 bp, chicken (Gallus Gallus)
  misc_feature (36): n=c or t
agatgcttaaggagaaaaacatctaaaagcagctgntgaagttaccaacttccttacattaacatgtcaag

SEQ ID NO: 44675 - DNA, 71 bp, chicken (Gallus Gallus)
  misc_feature (36): n=a or g
tgtgagctggggtgactcttcgtttgtcacttttanttataatagcttggcaaaacagaggaggaatacag

SEQ ID NO: 44676 - DNA, 71 bp, chicken (Gallus Gallus)
  misc_feature (36): n=c or t
ttgactgttttacctcgtgcaatgatcttatacctntgtcccaaaagaaacagtttgagacacctgaccat

SEQ ID NO: 44677 - DNA, 71 bp, chicken (Gallus Gallus)
  misc_feature (36): n=c or t
aacaaacccttacagtgatgttctgtttatcacagnctgtcacagctcatttgtggctggctcaaacctcc

SEQ ID NO: 44678 - DNA, 71 bp, chicken (Gallus Gallus)
  misc_feature (36): n=a or g
tactcctgtgcacctttaatctgttaatcttaagancgttatctgtcttcttgcttggtcagcttagtttt

SEQ ID NO: 44679 - DNA, 71 bp, chicken (Gallus Gallus)
  misc_feature (36): n=a or g
ttttcacgcaagagaattttcaggttagcttacaanttgacaactacataaaaagtgagattgtatctgcc

SEQ ID NO: 44680 - DNA, 71 bp, chicken (Gallus Gallus)
  misc_feature (36): n=c or t
taatgacttaaggtttgtccttcctattccaggctngttccaagcacttcttcaattttgcagagctggta

SEQ ID NO: 44681 - DNA, 71 bp, chicken (Gallus Gallus)
  misc_feature (36): n=c or t
tagtattcagaagtagaaaagaaaaagagggctagnggccacgacccaggccttctaccttggtgtttacc

SEQ ID NO: 44682 - DNA, 71 bp, chicken (Gallus Gallus)
  misc_feature (36): n=c or t
tcttgttatcagcaatggaattccagaaattaacantcaaaactttcagctgagaaacatatatgtttctg

SEQ ID NO: 44683 - DNA, 71 bp, chicken (Gallus Gallus)
  misc_feature (36): n=c or t
gcaggccccttcgctgctgcccttcagagctgtatngttagagcctgttttccaacagaatggtccaagca

SEQ ID NO: 44684 - DNA, 71 bp, chicken (Gallus Gallus)
  misc_feature (36): n=a or c
cttggagatacctcttcagagctggcagaaaacttngaagcacttgagagaaggctcccacatcctaaata

SEQ ID NO: 44685 - DNA, 71 bp, chicken (Gallus Gallus)
  misc_feature (36): n=a or g
cttaagagagttatcttacatggtgaatttcagganacacttcaaaatcctcaaagtgtagtgacttaata

SEQ ID NO: 44686 - DNA, 71 bp, chicken (Gallus Gallus)
  misc_feature (36): n=a or g
cttttctagttctcttctccagcagagagggctttntgttgctactgtgcaagagaagaaggcaagctggt

SEQ ID NO: 44687 - DNA, 71 bp, chicken (Gallus Gallus)
  misc_feature (36): n=c or t
atcacccaagaaaacaggtgtatgtgttcttaaggnttactatgattaatgaagtaataaacatattactg

SEQ ID NO: 44688 - DNA, 71 bp, chicken (Gallus Gallus)
  misc_feature (36): n=a or g
attctgaccagggctcagatccagcaatgagctgancatgctgaactgatgtgtccttagcccacctctcc

SEQ ID NO: 44689 - DNA, 71 bp, chicken (Gallus Gallus)
  misc_feature (36): n=a or g
gctctgttaaatgcaggtgaaaaatcacatgaaaantaaaaacacactgattcatttatgtgtacctaaga

SEQ ID NO: 44690 - DNA, 71 bp, chicken (Gallus Gallus)
  misc_feature (36): n=c or t
tctttttagtgactataaagtaacaatgtcttcacngtcagacaccttaaatgcttcttggtgaatgtaat

SEQ ID NO: 44691 - DNA, 71 bp, chicken (Gallus Gallus)
  misc_feature (36): n=g or t
gaagactgtgttccaataggaaacttgggtatgtgnttaacctgagaaatgcttgcatagcacattttctt

SEQ ID NO: 44692 - DNA, 71 bp, chicken (Gallus Gallus)
  misc_feature (36): n=c or t
gggaccctgtgtatttaagagcctgctagctgtagntgtgaatacagagaatggaaaaaggattgtagcct

SEQ ID NO: 44693 - DNA, 71 bp, chicken (Gallus Gallus)
  misc_feature (36): n=a or g
attggtttcctcttgttctccagccttttagtctgnctaacaggagaattctgtaatgaaaagtttcttta

SEQ ID NO: 44694 - DNA, 71 bp, chicken (Gallus Gallus)
  misc_feature (36): n=a or g
caccctttcaccaagaggaaaaaatagttcttggcngtgaaaatacaatggaagtacttgcctagcactct

SEQ ID NO: 44695 - DNA, 71 bp, chicken (Gallus Gallus)
  misc_feature (36): n=a or g
actaaacctttctcttgaccttatgaagaacctggnaaacatttcattagtcctgttaacgtggtactgtc

SEQ ID NO: 44696 - DNA, 71 bp, chicken (Gallus Gallus)
  misc_feature (36): n=a or g
ttcatcagtgcagctttgtactgtgaggttctacantataacaataagttaccatatccaatctcagtact

SEQ ID NO: 44697 - DNA, 71 bp, chicken (Gallus Gallus)
  misc_feature (36): n=a or c
actatatattttatatgaaaactaggaaatgttagncagagaattctacttttccagattttcactatgag

SEQ ID NO: 44698 - DNA, 71 bp, chicken (Gallus Gallus)
  misc_feature (36): n=c or t
ctctctccactggccacacagaagacctacaggggngttgtagttctaggagtctagcattaaatatgagt

SEQ ID NO: 44699 - DNA, 71 bp, chicken (Gallus Gallus)
  misc_feature (36): n=a or c
agcttttcagccccaattaccttatctgacaatccnctctgtagcacgctgtttcttgctatctcacataa

SEQ ID NO: 44700 - DNA, 71 bp, chicken (Gallus Gallus)
  misc_feature (36): n=a or g
ctcagtatgctcagaaaatattcagcaaggaacacnctaagaaattagactctgccagggcaagataaata

SEQ ID NO: 44701 - DNA, 71 bp, chicken (Gallus Gallus)
  misc_feature (36): n=a or g
tttttatgagctggaggtagaatctggactgtcctnggtgattgtcatcagtcagtggatatcttccaaga

SEQ ID NO: 44702 - DNA, 71 bp, chicken (Gallus Gallus)
  misc_feature (36): n=c or t
ataaaagttcagtttgctttgcgttagactttaggngagcaaacaatgtctgtttcacttcctcatttgtc

SEQ ID NO: 44703 - DNA, 71 bp, chicken (Gallus Gallus)
  misc_feature (36): n=a or g
gataagccaattgctgctgtgtgttgtaagaacgcnttttgaaccactgtgaagaattgtgatggcagtag

SEQ ID NO: 44704 - DNA, 71 bp, chicken (Gallus Gallus)
  misc_feature (36): n=a or c
cagatatttcatgttgtcagatggaaaggaaggttnttttcctcgtattcccaattaaaatgatacagtga

SEQ ID NO: 44705 - DNA, 71 bp, chicken (Gallus Gallus)
  misc_feature (36): n=a or g
gaaattttcagaaacttaacaagtttcaaaaacttnacaagtgcaagttggataaaagtagattgaagact

SEQ ID NO: 44706 - DNA, 71 bp, chicken (Gallus Gallus)
  misc_feature (36): n=a or c
tcatgtaatggttacatgattttgaaaaaagaatgnatattcttgagttagaccttggcttatttgacctg

SEQ ID NO: 44707 - DNA, 71 bp, chicken (Gallus Gallus)
  misc_feature (36): n=a or g
ttcctttgtgaaatgagtgctatgaaggaaaacagnaatttgttgtcttgtacttcatgatcgagaaagcc

SEQ ID NO: 44708 - DNA, 71 bp, chicken (Gallus Gallus)
  misc_feature (36): n=a or g
agtggtaaataggttcagcaacaccaggtgtctccnctcatttcttttgtgtttctactccaacttttctg

SEQ ID NO: 44709 - DNA, 71 bp, chicken (Gallus Gallus)
  misc_feature (36): n=a or g
cagaaactactgaagaaggatagaaatgctttgtantacaaatcctgctagcaaagcctcagaaagacttc

SEQ ID NO: 44710 - DNA, 71 bp, chicken (Gallus Gallus)
  misc_feature (36): n=g or t
gagcgtgctgattgtgtgcccttgtttcagctttgngcctatgcagaagttagcacaaagttgaaccgagt

SEQ ID NO: 44711 - DNA, 71 bp, chicken (Gallus Gallus)
  misc_feature (36): n=c or t
cattgtgtgttctggttctgatgtggtttctttccnagtggagcagctacctagctttatggtctcccctg

SEQ ID NO: 44712 - DNA, 71 bp, chicken (Gallus Gallus)
  misc_feature (36): n=a or g
acaatgcctcttttcaagaactttagcttactattntggcatgaaggtcaagactgtgttgttctgactga

SEQ ID NO: 44713 - DNA, 71 bp, chicken (Gallus Gallus)
  misc_feature (36): n=c or t
acattgagccatgagatctagagcaaactctgcttncaagcaccttgaactgaagaggtaaggagcctagg

SEQ ID NO: 44714 - DNA, 71 bp, chicken (Gallus Gallus)
  misc_feature (36): n=a or c
tgttagcaggtaagtattgaatgcagtcttcccaanctgttcaacaagcacatcttgccagctgatattaa

SEQ ID NO: 44715 - DNA, 71 bp, chicken (Gallus Gallus)
  misc_feature (36): n=a or g
gctatctttaatacctggaatgctcttcaaaactcntgttgccagctgcaaaggaataatgtaatactata

SEQ ID NO: 44716 - DNA, 71 bp, chicken (Gallus Gallus)
  misc_feature (36): n=c or t
ctcctaggccatgcattggatttcgaagaaacactncagatatttaaatctttattcacagctcacacaac

SEQ ID NO: 44717 - DNA, 71 bp, chicken (Gallus Gallus)
  misc_feature (36): n=a or g
ccatgctggtaagtatggaaaggagagttccttggnttttaataatgataatgctcaggatcaggaaactg

SEQ ID NO: 44718 - DNA, 71 bp, chicken (Gallus Gallus)
  misc_feature (36): n=c or t
tgcgcgctgaggtcaaaagcttcatccgcacagtgnccgttttctttaacctattttaataattgcagctg

SEQ ID NO: 44719 - DNA, 71 bp, chicken (Gallus Gallus)
  misc_feature (36): n=c or t
acatttgacaggctgagtccatcaacaacacactgntcaaagccagcaggcctttttcagagaaataaatg

SEQ ID NO: 44720 - DNA, 71 bp, chicken (Gallus Gallus)
  misc_feature (36): n=c or t
gctgagcttcacatgtatcaagaatgaattaattcnattcctacttaattacaggcaagtggacaagtaag

SEQ ID NO: 44721 - DNA, 71 bp, chicken (Gallus Gallus)
  misc_feature (36): n=c or t
gaccatgagcccagttctgctgcactggaaaaggangtcagctgaaagagggctctgcaattctattatgg

SEQ ID NO: 44722 - DNA, 71 bp, chicken (Gallus Gallus)
  misc_feature (36): n=a or c
aatcagtctctagcaaaagatactgtggtcctaaanagtacttaaagaactgttctcagaggttctgcatt

SEQ ID NO: 44723 - DNA, 71 bp, chicken (Gallus Gallus)
  misc_feature (36): n=c or t
cagaactgagcagcgatgctttactcattaagttgnccaagtgcttctttaagctttctgagctgatggaa

SEQ ID NO: 44724 - DNA, 71 bp, chicken (Gallus Gallus)
  misc_feature (36): n=a or g
ttgagaaggttgagcatgcagccattttaacacttnaattgattctagtactgcttacactttacataacc

SEQ ID NO: 44725 - DNA, 71 bp, chicken (Gallus Gallus)
  misc_feature (36): n=a or g
taattgactcagtgaaaaatcacagacaagtacgtntactggtcagtctagagcctttccttcctttctcc

SEQ ID NO: 44726 - DNA, 71 bp, chicken (Gallus Gallus)
  misc_feature (36): n=a or c
gactgctgtgaatgtcttccgtgttagcctcagcantgtgcctgagcacttaccctgtcacttaactttgc

SEQ ID NO: 44727 - DNA, 71 bp, chicken (Gallus Gallus)
  misc_feature (36): n=c or t
tgttcattttttccttatctgaagactagctcagtnccaagcaatgccaagacatggtgggtccttggtga

SEQ ID NO: 44728 - DNA, 71 bp, chicken (Gallus Gallus)
  misc_feature (36): n=a or g
atatcaacactgttctcttttagacgtgatcagaantattgtcagctgaattgatagcccattgccaagct

SEQ ID NO: 44729 - DNA, 71 bp, chicken (Gallus Gallus)
  misc_feature (36): n=a or c
agtgtttcaggcttgtttaatgtaacacagtgttgnaattctgtgacacagctatgctgagaaaatccagg

SEQ ID NO: 44730 - DNA, 71 bp, chicken (Gallus Gallus)
  misc_feature (36): n=c or t
ctccaaaagatccaatccaaagaaataaatcattgnaaaaatatctgaggatttgccagttcaaaatacct

SEQ ID NO: 44731 - DNA, 71 bp, chicken (Gallus Gallus)
  misc_feature (36): n=a or g
cttcaagtacggtgctgattttggctctgaaattcnttgtcgtctcttgctggcaaacagcttctgtcgtg

SEQ ID NO: 44732 - DNA, 71 bp, chicken (Gallus Gallus)
  misc_feature (36): n=a or g
acatttagcattaaatcactgcgatcaggtcagctntagaagatttccgttagctgaacaaagtctagaat

SEQ ID NO: 44733 - DNA, 71 bp, chicken (Gallus Gallus)
  misc_feature (36): n=c or t
acctgatatcctgtaagcataaatcagttactttgngtgaaatgaatgtcattagcgttgtctgctgtgag

SEQ ID NO: 44734 - DNA, 71 bp, chicken (Gallus Gallus)
  misc_feature (36): n=c or t
gctgtgaggctttaacagccatcactgtagatttcnctctgctttaggaggactgtgttatttttgggttg

SEQ ID NO: 44735 - DNA, 71 bp, chicken (Gallus Gallus)
  misc_feature (36): n=c or t
acatgcctgcctccagatgtgtctacctgcaaacancactgctctcttgacaggttctcctcattagcagc

SEQ ID NO: 44736 - DNA, 71 bp, chicken (Gallus Gallus)
  misc_feature (36): n=a or g
ctccaagctatatgacaccatttttatgcagtcctnaggctcacctctttcattgcttttctccccaccaa

SEQ ID NO: 44737 - DNA, 71 bp, chicken (Gallus Gallus)
  misc_feature (36): n=c or t
ccagcctctgttcagccatccccaaatctcaagttncgtaagctgagaaagaaagccatcatcttctcact

SEQ ID NO: 44738 - DNA, 71 bp, chicken (Gallus Gallus)
  misc_feature (36): n=a or g
ggcgggtgtctcagaggaggtcagtgtaagtaatcngcaagcattgcaagacttttcatatgggaaaggca

SEQ ID NO: 44739 - DNA, 71 bp, chicken (Gallus Gallus)
  misc_feature (36): n=c or t
gtctgcagtaagtaagaatgctctgttaattttgcntttgcagcagataggaaatgatctggttgccttgc

SEQ ID NO: 44740 - DNA, 71 bp, chicken (Gallus Gallus)
  misc_feature (36): n=c or t
tttgggaaagcaaaacttgcattcctccagcttatnctggagaaaaagcatacaggaagacggcatcgctt

SEQ ID NO: 44741 - DNA, 71 bp, chicken (Gallus Gallus)
  misc_feature (36): n=c or t
gtgtgcctgagctgggcaagtgctttttgatctctncataccctgcgctgtgcatttggggtaatggggag

SEQ ID NO: 44742 - DNA, 71 bp, chicken (Gallus Gallus)
  misc_feature (36): n=a or g
gtaaggtggagtaacatttccctgggtgaccgagtncagctcagactcccaagtttcttaaatactttctc

SEQ ID NO: 44743 - DNA, 71 bp, chicken (Gallus Gallus)
  misc_feature (36): n=c or t
gatccagtctccttcagcacacccttaagagccctnggtgtcatgacaaactaattgcatgtgttagggga

SEQ ID NO: 44744 - DNA, 71 bp, chicken (Gallus Gallus)
  misc_feature (36): n=c or t
ctgggctagctcaggaaccttaccaaggcacccagnggttttgttattcagagggttggccagggcaaagt

SEQ ID NO: 44745 - DNA, 71 bp, chicken (Gallus Gallus)
  misc_feature (36): n=g or t
agcacagcgtgctgcattttctacaacagcaagagnacttctgctgcatgggaaatatgcaaccttctaga

SEQ ID NO: 44746 - DNA, 71 bp, chicken (Gallus Gallus)
  misc_feature (36): n=c or t
ggctgcatgtcccgaataatcatgccaaagtatacnctgaacctcaggttgagctatttaagaagataatg

SEQ ID NO: 44747 - DNA, 71 bp, chicken (Gallus Gallus)
  misc_feature (36): n=a or g
agggaggattaattcacaaattctcttcaagaaatngggaattgtgttataataacagcagggagctattc

SEQ ID NO: 44748 - DNA, 71 bp, chicken (Gallus Gallus)
  misc_feature (36): n=c or t
cagccaaggcagtacttgtcaaaagtaaaagtaagnaagcccaggaataaacaagagtataataaaagagt

SEQ ID NO: 44749 - DNA, 71 bp, chicken (Gallus Gallus)
  misc_feature (36): n=a or g
ggtaagcttctgatatacaacagtatatactaagantaaatatgcagctatgtgtaaggaaggttggtcag

SEQ ID NO: 44750 - DNA, 71 bp, chicken (Gallus Gallus)
  misc_feature (36): n=c or t
atacctgtggaggtataattcaaaaacatttgctgntctgacttgcctttgtaagtgacaggtggatttga

SEQ ID NO: 44751 - DNA, 71 bp, chicken (Gallus Gallus)
  misc_feature (36): n=a or g
actatgaggccagcctgattactcttattcagatantgccaagatttacagtactgatggtaacctagtta

SEQ ID NO: 44752 - DNA, 71 bp, chicken (Gallus Gallus)
  misc_feature (36): n=c or t
ctcaatgagaagatcttacaccacttggataattgntactagttttaaggcataatatatatgtataatac

SEQ ID NO: 44753 - DNA, 71 bp, chicken (Gallus Gallus)
  misc_feature (36): n=a or g
aaagattcaacttaccagaaagaatgactcctgcangacagagaaactcaattaacaaaaacataatatag

SEQ ID NO: 44754 - DNA, 71 bp, chicken (Gallus Gallus)
  misc_feature (36): n=a or g
tttctaaaatgacaatttatgttacatctgctattntattagtgcttgctacattactaaaaaggaaaaaa

SEQ ID NO: 44755 - DNA, 71 bp, chicken (Gallus Gallus)
  misc_feature (36): n=a or g
caaagaactaaagaaggtactgagctttgaagaacnagattttattttcttgtagcatacttcttgtttta

SEQ ID NO: 44756 - DNA, 71 bp, chicken (Gallus Gallus)
  misc_feature (36): n=c or t
tttctctcacacttatgtcaaaatttataagctgcnctgtgaaacagcactacattatttcctcacttgtt

SEQ ID NO: 44757 - DNA, 71 bp, chicken (Gallus Gallus)
  misc_feature (36): n=a or g
agatgagtttcatgaaatttccatttctgtagatcnaaagatattgaaatactcatatctgcttttatatc

SEQ ID NO: 44758 - DNA, 71 bp, chicken (Gallus Gallus)
  misc_feature (36): n=a or g
cttcataatttcagtgatgtgtagatcttgtcctcntgtgatattcacagaacattttctatttaacagag

SEQ ID NO: 44759 - DNA, 71 bp, chicken (Gallus Gallus)
  misc_feature (36): n=c or t
cggcagtacttttgtgtactgtatcagtgcctggantgacagcctcatgacacttctttatatgtgaactt

SEQ ID NO: 44760 - DNA, 71 bp, chicken (Gallus Gallus)
  misc_feature (36): n=c or t
tttcaagattcaaaataccaaattaaactcaagagnatccatatactgctaacagtaatgaataatcataa

SEQ ID NO: 44761 - DNA, 71 bp, chicken (Gallus Gallus)
  misc_feature (36): n=a or g
atggaatgatttggtttttttattgtgatgaagtgnaagctcatacaaatcttctgattaaaaaagacatc

SEQ ID NO: 44762 - DNA, 71 bp, chicken (Gallus Gallus)
  misc_feature (36): n=a or g
aatgagaagttctgtcttgctctataacctgcttgngataaacagtgtaaaacaggagcagtcacacagca

SEQ ID NO: 44763 - DNA, 71 bp, chicken (Gallus Gallus)
  misc_feature (36): n=a or g
tgcaatctctccttccaaaagggagctgtattactnagttcattgacagttgaccaaatacattaccttca

SEQ ID NO: 44764 - DNA, 71 bp, chicken (Gallus Gallus)
  misc_feature (36): n=a or g
gacaataacaaagtctgagactatataatataattntttgttcacttgttggctaaagtagaggcctgaaa

SEQ ID NO: 44765 - DNA, 71 bp, chicken (Gallus Gallus)
  misc_feature (36): n=c or t
aagtagataaacgagaatcttgatgctattaatttntgtcctcttaaataagcagaccaaggttagagctg

SEQ ID NO: 44766 - DNA, 71 bp, chicken (Gallus Gallus)
  misc_feature (36): n=a or g
agcatacaagtatatctttcaaataatacgagtacntatgagaaaacgtgcattaccaccaaactcttagg

SEQ ID NO: 44767 - DNA, 71 bp, chicken (Gallus Gallus)
  misc_feature (36): n=c or t
aaaagctgcgtgacaaaatacaggaatgcaggttgntacagaatttctacattccctgaaaatacacttta

SEQ ID NO: 44768 - DNA, 71 bp, chicken (Gallus Gallus)
  misc_feature (36): n=c or t
tcagatgcatattacttagcaaatgctttttgatgngactgatatgagttctctgacttctgtgttacaag

SEQ ID NO: 44769 - DNA, 71 bp, chicken (Gallus Gallus)
  misc_feature (36): n=a or g
agtgaattaataacactgcgacaagaaaaaaactcnaagaccataaaaacacaaaagaagttgttctctgc

SEQ ID NO: 44770 - DNA, 71 bp, chicken (Gallus Gallus)
  misc_feature (36): n=a or g
aagtgatcacagaaatacatacataaaaccaaacantgtctatgagattagccttgtcccacagtatactt

SEQ ID NO: 44771 - DNA, 71 bp, chicken (Gallus Gallus)
  misc_feature (36): n=a or g
ttctctaaattggagttcagtctagcaaactgcctngaaaaaaacaatcccacaagcaattctgttttcaa

SEQ ID NO: 44772 - DNA, 71 bp, chicken (Gallus Gallus)
  misc_feature (36): n=c or t
atatggcttaggtacttcagaacagtccctagatcntacccaggcagcacacccaggctgttgtcagctgt

SEQ ID NO: 44773 - DNA, 71 bp, chicken (Gallus Gallus)
  misc_feature (36): n=c or t
aaaacacataacttcaaaatgcagtactgagaaagncctgttcttatcaaagagatgactgtcactgaaaa

SEQ ID NO: 44774 - DNA, 71 bp, chicken (Gallus Gallus)
  misc_feature (36): n=c or t
gagattcagataatacatcatgagaatcaaacaaancaacaagctaacaagtttctgcaggtctcaccata

SEQ ID NO: 44775 - DNA, 71 bp, chicken (Gallus Gallus)
  misc_feature (36): n=c or t
aatgcaccctacaaaactctagtttaattcttcttntcagtttactttccttgtcaagttttgtacttgta

SEQ ID NO: 44776 - DNA, 71 bp, chicken (Gallus Gallus)
  misc_feature (36): n=c or t
acaattgtaacatctacccaggagaaaagtataacnacttcctgtgtaaagatggttgcaacatagtaagg

SEQ ID NO: 44777 - DNA, 71 bp, chicken (Gallus Gallus)
  misc_feature (36): n=a or g
aaaccagaaaacaaatactagacaagtatgcacacntgcaccattaggctctacatctccccaaattacaa

SEQ ID NO: 44778 - DNA, 71 bp, chicken (Gallus Gallus)
  misc_feature (36): n=c or t
gcagagtagagcccagtaccttggtgtctcatgccnaagtatgtgtcctaccttaaggttccttctttcag

SEQ ID NO: 44779 - DNA, 71 bp, chicken (Gallus Gallus)
  misc_feature (36): n=g or t
gatctgcaaagggcaatcatgaaaagcactgcatgnttctgtgcagggtgcgatgctgccatgtctgttgc

SEQ ID NO: 44780 - DNA, 71 bp, chicken (Gallus Gallus)
  misc_feature (36): n=g or t
caaggctgtaagttgtggagaaggtgccttgcagtntattacatctctgcaggaatctgccacacttcttt

SEQ ID NO: 44781 - DNA, 71 bp, chicken (Gallus Gallus)
  misc_feature (36): n=c or t
gggcactatggagaagatgctcatggttatggccangggcggatggtaggaggagtgacagcagggcatca

SEQ ID NO: 44782 - DNA, 71 bp, chicken (Gallus Gallus)
  misc_feature (36): n=a or g
gaagttcctctagagggaatttctgtgacatcagcngctgttacagccttaggctgcaactcaagattgga

SEQ ID NO: 44783 - DNA, 71 bp, chicken (Gallus Gallus)
  misc_feature (36): n=a or g
ctctgacctgctgacagctgatttggtccagtggancatatgctagagggtacagcaccagtcagacgcaa

SEQ ID NO: 44784 - DNA, 71 bp, chicken (Gallus Gallus)
  misc_feature (36): n=a or g
tgaagaaataaaaaaaaacattcaaaaatgtaagangttgtgggattagccctgtaaatactgaacaggtc

SEQ ID NO: 44785 - DNA, 71 bp, chicken (Gallus Gallus)
  misc_feature (36): n=c or t
caaaattgcttttcatgcaacttcctttgtaacgtngtgttcttttcagtgctttttgtagcttaattccc

SEQ ID NO: 44786 - DNA, 71 bp, chicken (Gallus Gallus)
  misc_feature (36): n=c or t
ctaagacctgtgggacctcctatccagttcttgaantgttgcaaatctgcattttctaggaaattttgatg

SEQ ID NO: 44787 - DNA, 71 bp, chicken (Gallus Gallus)
  misc_feature (36): n=c or t
tgataacagctcccaaagaagagctccatccctccnggtacagagggaacttgatccttacctgtaactat

SEQ ID NO: 44788 - DNA, 71 bp, chicken (Gallus Gallus)
  misc_feature (36): n=a or g
tcaaatcactaagtagctatcactctgctcttaacnggagaaagatccatttccacacgtcatttggaggt

SEQ ID NO: 44789 - DNA, 71 bp, chicken (Gallus Gallus)
  misc_feature (36): n=c or t
atgacatactcaggagaccaagaggaaataagcccnagctgcaaagcttggtccagagaccaacttttcca

SEQ ID NO: 44790 - DNA, 71 bp, chicken (Gallus Gallus)
  misc_feature (36): n=a or c
tcagggctggaagagggggattgttttgaaaaccangtaggccgtgctgcttaatgctctaccccaaatgc

SEQ ID NO: 44791 - DNA, 71 bp, chicken (Gallus Gallus)
  misc_feature (36): n=c or t
aaagtaatctgctttgctcccatggcaggtaaggangtggggaaggagagccctaactgccaccgaagtgg

SEQ ID NO: 44792 - DNA, 71 bp, chicken (Gallus Gallus)
  misc_feature (36): n=a or g
gaggcataaggacaggcactggatgagacggcgganttgaggctcgggctattcagattgttgatgtttcc

SEQ ID NO: 44793 - DNA, 71 bp, chicken (Gallus Gallus)
  misc_feature (36): n=a or g
tactctgtcattctccccaaccatgtagtcgctgantgattatggtgctcagcaagcaatctgggatccaa

SEQ ID NO: 44794 - DNA, 71 bp, chicken (Gallus Gallus)
  misc_feature (36): n=a or g
gtgagggagagaagggggcccaggtgatgtggtgcntgctgaggggtggggagagaaagcaggtacgtctt

SEQ ID NO: 44795 - DNA, 71 bp, chicken (Gallus Gallus)
  misc_feature (36): n=a or g
atcctgtagcttttgtggacagagagaagggagtgngggaacaggagaggagagaggcaaggagaggaaag

SEQ ID NO: 44796 - DNA, 71 bp, chicken (Gallus Gallus)
  misc_feature (36): n=c or t
gaaactggactttctttagagcctcttgctgtgtcncagatacgtgagggcaacaaagttgtaggggacta

SEQ ID NO: 44797 - DNA, 71 bp, chicken (Gallus Gallus)
  misc_feature (36): n=c or t
tcccaaagaggtgctttggtacatcccacagctgangctttgtgtttgctctagtcaagggggtactggaa

SEQ ID NO: 44798 - DNA, 71 bp, chicken (Gallus Gallus)
  misc_feature (36): n=g or t
taaatcaggtctgtgaactattcaaactatcttcancagcttggagtggatttaagggccacgcactccat

SEQ ID NO: 44799 - DNA, 71 bp, chicken (Gallus Gallus)
  misc_feature (36): n=a or g
ccctgctgacagacatactcaggttcattgagaaangtcttcataaccccggacacgttctaaattcacca

SEQ ID NO: 44800 - DNA, 71 bp, chicken (Gallus Gallus)
  misc_feature (36): n=g or t
tgttttcatagtataaagtgatattttgaatcactntgtcatcaaggactaaatatttttgacttcacgca

SEQ ID NO: 44801 - DNA, 71 bp, chicken (Gallus Gallus)
  misc_feature (36): n=a or g
tctgccacaatgagacacattctagtataggttganctaccagacagacctgcatcaagtccacaacaaat

SEQ ID NO: 44802 - DNA, 71 bp, chicken (Gallus Gallus)
  misc_feature (36): n=g or t
agtacaatgaactgtggcactgttgctttcccccancgtttccagggagctggtccaccctgtctttgtaa

SEQ ID NO: 44803 - DNA, 71 bp, chicken (Gallus Gallus)
  misc_feature (36): n=c or t
tgtgtacagggaaataacccaagttgcatctcttcncagaatgggatctgcccagtcttactcaggtcaag

SEQ ID NO: 44804 - DNA, 71 bp, chicken (Gallus Gallus)
  misc_feature (36): n=c or t
ctggccacatgtaccagcatctcttcagcctctttnggcacctactcttgaactcttgaaggactgccctt

SEQ ID NO: 44805 - DNA, 71 bp, chicken (Gallus Gallus)
  misc_feature (36): n=c or t
gccagtatctagtaggtgacagtcactaccacgagnaacctaaagcttcgtagacaagacaggaaaacggg

SEQ ID NO: 44806 - DNA, 71 bp, chicken (Gallus Gallus)
  misc_feature (36): n=c or t
aagcatccaccctactgtacacagagcaatggggcngggatgacaaagaccacctcgctgtaatacttttc

SEQ ID NO: 44807 - DNA, 71 bp, chicken (Gallus Gallus)
  misc_feature (36): n=c or t
ggtagatatagtttgtaggtgtttcatgatgagctntgaaggaagcagtatgttcaacaaagagcaagaac

SEQ ID NO: 44808 - DNA, 71 bp, chicken (Gallus Gallus)
  misc_feature (36): n=c or t
tgttttccagaaggattgatgttataattatctaantgaaactactcaaagtatttgtgccagtcatagat

SEQ ID NO: 44809 - DNA, 71 bp, chicken (Gallus Gallus)
  misc_feature (36): n=c or t
catcattaaagggcaggaggcagctccctgacattntgctactatctcatcatttgagagacagcagcctg

SEQ ID NO: 44810 - DNA, 71 bp, chicken (Gallus Gallus)
  misc_feature (36): n=a or g
cagagcttgattgtcacttggctgtaatactacacnttgctgtgatgtgatgctagatctagctgagtctg

SEQ ID NO: 44811 - DNA, 71 bp, chicken (Gallus Gallus)
  misc_feature (36): n=a or g
acccggaaactggagagatgatgtaggtatcagtcnctactaatatggcacacaaagcacctggagattat

SEQ ID NO: 44812 - DNA, 71 bp, chicken (Gallus Gallus)
  misc_feature (36): n=a or g
attttacatcttatcagttatgcaaccactggagtncaagatccttcctgagcaaaacttgtattaacagt

SEQ ID NO: 44813 - DNA, 71 bp, chicken (Gallus Gallus)
  misc_feature (36): n=a or g
ttaaacgaacatttctctctctaatccagggcaacnaagtacaaactctattccactacccacctcctgtt

SEQ ID NO: 44814 - DNA, 71 bp, chicken (Gallus Gallus)
  misc_feature (36): n=c or t
tcttcaaggtcagggattttacacttgtttagaaanataccactgaagtaataaaaccaaagtaatttcta

SEQ ID NO: 44815 - DNA, 71 bp, chicken (Gallus Gallus)
  misc_feature (36): n=g or t
ctgagtcactgtaaagcatgcccctatccttaaagngcactacaagtctgtagcaataccaagcacaaact

SEQ ID NO: 44816 - DNA, 71 bp, chicken (Gallus Gallus)
  misc_feature (36): n=a or g
acttatttcagtccttgtatttgtcttgtagttggntatttatgctaagccagtttttgttccaggagttt

SEQ ID NO: 44817 - DNA, 71 bp, chicken (Gallus Gallus)
  misc_feature (36): n=c or t
attcatacttattactgtcagctttgtttatctttncttgtgatatcatttatcatactgcaagctttgag

SEQ ID NO: 44818 - DNA, 71 bp, chicken (Gallus Gallus)
  misc_feature (36): n=a or g
tcccttttatgttatcagtctgaaaagacaaaaccnaactccaatgtgatttcacacaagcttcttttaga

SEQ ID NO: 44819 - DNA, 71 bp, chicken (Gallus Gallus)
  misc_feature (36): n=a or g
gttttctaagttacttgctccaagggattatgtgtntatttactccttacgtacagtcactgctaagacca

SEQ ID NO: 44820 - DNA, 71 bp, chicken (Gallus Gallus)
  misc_feature (36): n=c or t
cagcctacagctggatcagacataagctgtctcacnttcatgtcagcttggcttgtctgtcagcttcgctg

SEQ ID NO: 44821 - DNA, 71 bp, chicken (Gallus Gallus)
  misc_feature (36): n=c or t
taaggatcccgggaggttgacagagcacgagtttgnccctgggggaaggccgggagagggcaaggcagccc

SEQ ID NO: 44822 - DNA, 71 bp, chicken (Gallus Gallus)
  misc_feature (36): n=a or g
tgactaagtacctgcttgcatgcaagtgtgactgcngcatttggatttcggattttgtgaccctcatccaa

SEQ ID NO: 44823 - DNA, 71 bp, chicken (Gallus Gallus)
  misc_feature (36): n=a or g
cacctgcttctggcatacttccaagttgctcacagnaatgttcagagtaaattctcctggaagagcctccc

SEQ ID NO: 44824 - DNA, 71 bp, chicken (Gallus Gallus)
  misc_feature (36): n=a or c
ccagtgaaattactgatattctctcaaatggtttcnaaaggggttagcactggacagtggtaaggaaagag

SEQ ID NO: 44825 - DNA, 71 bp, chicken (Gallus Gallus)
  misc_feature (36): n=a or g
tgggtcttcatggaggtatacaaaaccttacacagngtcatcactgccatcatggagcttgttttcactgg

SEQ ID NO: 44826 - DNA, 71 bp, chicken (Gallus Gallus)
  misc_feature (36): n=c or t
cacatagcactggtgtcacaaagatgaccatccatnccaggagtgcaactctgctgtgggtaacaacaccg

SEQ ID NO: 44827 - DNA, 71 bp, chicken (Gallus Gallus)
  misc_feature (36): n=c or t
aggtttccttgttttacctcatcttgtatccttccnttatcagttatattctcctaccaacagggtacaca

SEQ ID NO: 44828 - DNA, 71 bp, chicken (Gallus Gallus)
  misc_feature (36): n=a or g
gaatttgaataggtcccgttgaattgtgttaaggcnaatctgcttagggaggaatggggctgcaggaattc

SEQ ID NO: 44829 - DNA, 71 bp, chicken (Gallus Gallus)
  misc_feature (36): n=c or t
aggagaggtcatagatggtgactgggatgacagagnagcacagagctctggctccaagtgcttcagacaag

SEQ ID NO: 44830 - DNA, 71 bp, chicken (Gallus Gallus)
  misc_feature (36): n=c or t
ggcagctgtaatgcatagcctgttctccaggtactngcacaaaagtgacagagacacgtcaaatttaccag

SEQ ID NO: 44831 - DNA, 71 bp, chicken (Gallus Gallus)
  misc_feature (36): n=c or t
cacaaaactactaatgaataaacaacaatacctttnatcaaatgaaacatttactcttaataatactcctg

SEQ ID NO: 44832 - DNA, 71 bp, chicken (Gallus Gallus)
  misc_feature (36): n=c or t
tgtaagtcttctgcacaataatcttctaacgtgcantataggtcaaaggagaatttaagtttgatggaagc

SEQ ID NO: 44833 - DNA, 71 bp, chicken (Gallus Gallus)
  misc_feature (36): n=c or t
taaaaataaaaagcagaacaattgttactttaaaanaccaactacagaagaacaggaacataggaatgtaa

SEQ ID NO: 44834 - DNA, 71 bp, chicken (Gallus Gallus)
  misc_feature (36): n=c or t
tgactaaatcaccatagctttcctcattagaaatcnaactaccaacttttctagtttattagtaatcctgt

SEQ ID NO: 44835 - DNA, 71 bp, chicken (Gallus Gallus)
  misc_feature (36): n=a or g
tgaccaggaacctaacagtgtactcagtcatgcctntggttaaccaatggctgttgaccaaatgtagggaa

SEQ ID NO: 44836 - DNA, 71 bp, chicken (Gallus Gallus)
  misc_feature (36): n=a or c
ttccaacttcaaagctacttcaggtcctgtgcaganaaggggacgcgggagcaaggcagtggtgagctgaa

SEQ ID NO: 44837 - DNA, 71 bp, chicken (Gallus Gallus)
  misc_feature (36): n=g or t
aaacaagcaaaccctcatgtaatcgacagtattttntttctgtaatactctgtggatatcacagcttgagc

SEQ ID NO: 44838 - DNA, 71 bp, chicken (Gallus Gallus)
  misc_feature (36): n=c or t
gagttgacctctttcaggactggagaagagcgcatngctgatgactctgagataggtgactggtgagtgtt

SEQ ID NO: 44839 - DNA, 71 bp, chicken (Gallus Gallus)
  misc_feature (36): n=a or g
aaacgctcaatacttctatctccctgtaaggagagncagggatcactggtgttttggtttgatggatgaga

SEQ ID NO: 44840 - DNA, 71 bp, chicken (Gallus Gallus)
  misc_feature (36): n=c or t
aatgccttaatggtcatacgcagaactgggctaccntcaaagtagtttgggaatagcatctcccttcctat

SEQ ID NO: 44841 - DNA, 71 bp, chicken (Gallus Gallus)
  misc_feature (36): n=g or t
ccatatagccatcatgagcatcttcataacaaaccnattttatttcacctagactctccttaaaaaatgtt

SEQ ID NO: 44842 - DNA, 71 bp, chicken (Gallus Gallus)
  misc_feature (36): n=a or g
aagcttcagagcctcatgcatccctgcagctgatantttccggttgatattcctatatctgcactgcagga

SEQ ID NO: 44843 - DNA, 71 bp, chicken (Gallus Gallus)
  misc_feature (36): n=c or t
aaccaaaccatttccttgaagtactgctggtaccgnagagatcccagaactgggactcatgatcccattcc

SEQ ID NO: 44844 - DNA, 71 bp, chicken (Gallus Gallus)
  misc_feature (36): n=c or t
gaaatcctgcttctgtcttttagagaaaccttgacntagaataaaccagaatcaatcctgaaacagaacaa

SEQ ID NO: 44845 - DNA, 71 bp, chicken (Gallus Gallus)
  misc_feature (36): n=a or c
ggaacaggaacccatagctttctctttcagtgtgcnatggcttgtttctttctctgagtgcacatccatac

SEQ ID NO: 44846 - DNA, 71 bp, chicken (Gallus Gallus)
  misc_feature (36): n=a or g
ttcagctgacactatgacataacaaatagaagtgcncaaaaagcacttctggagacctcattaattgcttc

SEQ ID NO: 44847 - DNA, 71 bp, chicken (Gallus Gallus)
  misc_feature (36): n=a or g
ttgcctactgtactgagacctttttctgttctgttncgtgattgtcaaggacgtgtaagcactactggctg

SEQ ID NO: 44848 - DNA, 71 bp, chicken (Gallus Gallus)
  misc_feature (36): n=a or c
tgtatggacttccagttagaactgagtgcttttagntagaatttatacaatcaaaatatttgttctgaaaa

SEQ ID NO: 44849 - DNA, 71 bp, chicken (Gallus Gallus)
  misc_feature (36): n=a or g
ctggatagtgcttcatactattaataacttctaagnaaagataccgtgtcccaagagaaaagcacactggg

SEQ ID NO: 44850 - DNA, 71 bp, chicken (Gallus Gallus)
  misc_feature (36): n=a or g
aagaagatgctgtaaagcaggttggtgctctgcttnttcttatacagtgctgtaagaccaaagctggaaga

SEQ ID NO: 44851 - DNA, 71 bp, chicken (Gallus Gallus)
  misc_feature (36): n=a or g
tatgaactgtagaatgaaaaagcatcagctgtttcnctttgtaggcaacctgatgatccctcctttgaaaa

SEQ ID NO: 44852 - DNA, 71 bp, chicken (Gallus Gallus)
  misc_feature (36): n=a or g
gaccattcagttgaactcttcctatggagacatacngaaatgctaatcttctggtaacctgtgacaagact

SEQ ID NO: 44853 - DNA, 71 bp, chicken (Gallus Gallus)
  misc_feature (36): n=c or t
aatagataatctaatgttctgccatttttaaaagtnctaattccttcatcagagttaaagatgtttctaaa

SEQ ID NO: 44854 - DNA, 71 bp, chicken (Gallus Gallus)
  misc_feature (36): n=a or c
gtttctttattttacaggaagtgatgcatgccctangacagacttggcacacgagttgctttgtttgtgct

SEQ ID NO: 44855 - DNA, 71 bp, chicken (Gallus Gallus)
  misc_feature (36): n=c or t
cgcaagaacaagcattaattctgaggatctacaagncttggcgtagcagcttgcaaccaagcaatacttca

SEQ ID NO: 44856 - DNA, 71 bp, chicken (Gallus Gallus)
  misc_feature (36): n=a or c
tctgaaggagcctcactaagaagtattttccatccnaaaaatgcaaagtactgcaatatgaaagagttcaa

SEQ ID NO: 44857 - DNA, 71 bp, chicken (Gallus Gallus)
  misc_feature (36): n=c or t
ccacagaagatggctgttctttattctatcccaaanttcagttactgccagattttgtaaggagcatttta

SEQ ID NO: 44858 - DNA, 71 bp, chicken (Gallus Gallus)
  misc_feature (36): n=a or g
ggcagaaaaatagtaataactgacagatactgcacnaagagggaaccttgaggttggctgtagttttatga

SEQ ID NO: 44859 - DNA, 71 bp, chicken (Gallus Gallus)
  misc_feature (36): n=c or t
gtatatcttcatatttctcttgttcactacccaatngtataatctaaagtgactgttcagaagaaataaaa

SEQ ID NO: 44860 - DNA, 71 bp, chicken (Gallus Gallus)
  misc_feature (36): n=c or t
ggtccagcccctgcccaaagcagggaggtcagctgntggtaaatggctagcaagaagtaacatggaatttg

SEQ ID NO: 44861 - DNA, 71 bp, chicken (Gallus Gallus)
  misc_feature (36): n=c or t
tctgtttactaggtcactaaacttctgcaggtagantaaatgagtactgttcatggtaaaaagaaacagtc

SEQ ID NO: 44862 - DNA, 71 bp, chicken (Gallus Gallus)
  misc_feature (36): n=c or t
tccgtccactttaaactggtcctacactgactcatntacctattgaatgaaacgtaatttgtatgtaagca

SEQ ID NO: 44863 - DNA, 71 bp, chicken (Gallus Gallus)
  misc_feature (36): n=c or t
atagcactctatgttattaacaccaatctgctgaangttggtatagctcctggtcttatatcacagtatat

SEQ ID NO: 44864 - DNA, 71 bp, chicken (Gallus Gallus)
  misc_feature (36): n=a or g
ggccgcgctgcctgggcgcggctcaggctgaagctnagactcggacccaacccaacgcccgcgagcgcgcg

SEQ ID NO: 44865 - DNA, 71 bp, chicken (Gallus Gallus)
  misc_feature (36): n=a or g
taatttttgtcacactgtgccttaagtaatttcacntaatgattcctttgaaaggtgtgtgtatgcaggag

SEQ ID NO: 44866 - DNA, 71 bp, chicken (Gallus Gallus)
  misc_feature (36): n=c or t
ctaaagcccttttcactgggcaaaactttctatgcnttggtggaatcatacagtaatttttgttttatttt

SEQ ID NO: 44867 - DNA, 71 bp, chicken (Gallus Gallus)
  misc_feature (36): n=g or t
atcgatgtggcaaataaattccatccctagtctttntcttgcacatctaaagatggccatgtctctagtta

SEQ ID NO: 44868 - DNA, 71 bp, chicken (Gallus Gallus)
  misc_feature (36): n=a or g
aaaagtgcactgtaacagccttccttaaattctcantgctcactgagcacctttctgtcaatgcacatgaa

SEQ ID NO: 44869 - DNA, 71 bp, chicken (Gallus Gallus)
  misc_feature (36): n=a or g
acattaaggggcttggtaccttctaataaattgaanaaatccatttaatgttcagaggaggaagatggatg

SEQ ID NO: 44870 - DNA, 71 bp, chicken (Gallus Gallus)
  misc_feature (36): n=g or t
ctaactgccgtaggctatttgcaatgtgaagccagnggatttaggagaacatcatgctcctggctgctgtg

SEQ ID NO: 44871 - DNA, 71 bp, chicken (Gallus Gallus)
  misc_feature (36): n=a or g
ttgcacgaattcaggtaaaaatactgtgctggagcnctgacagaatctgatatttcaaggcagaattaact

SEQ ID NO: 44872 - DNA, 71 bp, chicken (Gallus Gallus)
  misc_feature (36): n=a or g
tgaaatagctcttgtatcctaagagatattgcagtnagcaagcgtattagtatgactggccatgtaggaga

SEQ ID NO: 44873 - DNA, 71 bp, chicken (Gallus Gallus)
  misc_feature (36): n=a or g
atttaaaacctccccatgccatgaaaacattctganacaataattgctttcaagccaattgtcaggaagga

SEQ ID NO: 44874 - DNA, 71 bp, chicken (Gallus Gallus)
  misc_feature (36): n=c or t
catgaatgagtatttatggtttgtatatcactggtntgagcagcaatttctgccatagaagctaacagatc

SEQ ID NO: 44875 - DNA, 71 bp, chicken (Gallus Gallus)
  misc_feature (36): n=a or g
ttttgcagcctttaaatccaagtcttaaataccgcncagcagttctgacttcattaaatgaagacaatgta

SEQ ID NO: 44876 - DNA, 71 bp, chicken (Gallus Gallus)
  misc_feature (36): n=c or t
aagattcttttagattgtcaaagatgacacaattanagggaggttacctagacttaaaaacaaaaacctga

SEQ ID NO: 44877 - DNA, 71 bp, chicken (Gallus Gallus)
  misc_feature (36): n=a or g
ttttgcaggtgaaatacccagaacgtcccccacaantgctgatgaactgttatcttcagatacatgcttgt

SEQ ID NO: 44878 - DNA, 71 bp, chicken (Gallus Gallus)
  misc_feature (36): n=c or t
atgctgtttgacatggaagtacacagcatctgaganacagatgcgtaactctgctcttacacagggggaac

SEQ ID NO: 44879 - DNA, 71 bp, chicken (Gallus Gallus)
  misc_feature (36): n=c or t
cacaaacctccagcctgaggcctaaacaaaccaaangacacctcaaatctggagttttttgtgtgacctgg

SEQ ID NO: 44880 - DNA, 71 bp, chicken (Gallus Gallus)
  misc_feature (36): n=c or t
ccagggcagctacatagcccccaggtcaggtgtccngaatgaagccctggcttaaactcctgtcacattat

SEQ ID NO: 44881 - DNA, 71 bp, chicken (Gallus Gallus)
  misc_feature (36): n=a or g
aaaaaacaattagacagtgcaccccagggcaagagnagccagagacaactagacctgttacagatgacaag

SEQ ID NO: 44882 - DNA, 71 bp, chicken (Gallus Gallus)
  misc_feature (36): n=c or t
agcccactggatgcactcgccaccgccaagtctctnacccccaaacatggggagcccatggggcctcttcc

SEQ ID NO: 44883 - DNA, 71 bp, chicken (Gallus Gallus)
  misc_feature (36): n=g or t
gcgcagagtgaaaaaataagtttgttaatgcatttnatattggtattgttcatcagaatagtctgtaagta

SEQ ID NO: 44884 - DNA, 71 bp, chicken (Gallus Gallus)
  misc_feature (36): n=c or t
aagtggcgcaatcagacaacgagctcctgattagcnttttgctggtgtatgggtgagacaaaggattcctg

SEQ ID NO: 44885 - DNA, 71 bp, chicken (Gallus Gallus)
  misc_feature (36): n=c or t
ttcaagggagctcaggctactttgctggagtggagngtgccatctcatcccctcccattcagggtatccca

SEQ ID NO: 44886 - DNA, 71 bp, chicken (Gallus Gallus)
  misc_feature (36): n=c or t
cacgttggtatctcctaacagaaaggcaaaggtgangtgaagaagaagggccagctcgacccctatgccta

SEQ ID NO: 44887 - DNA, 71 bp, chicken (Gallus Gallus)
  misc_feature (36): n=c or t
gtcctcaaagcaaccttaaaagtgaagtcacttctngtgtctctgcagcccattcccaccagagttctttt

SEQ ID NO: 44888 - DNA, 71 bp, chicken (Gallus Gallus)
  misc_feature (36): n=a or g
aattgacctggttgcaggtgcagcttcactggcttnagtggctttgaatcagcaggcaggaaaaagcagcc

SEQ ID NO: 44889 - DNA, 71 bp, chicken (Gallus Gallus)
  misc_feature (36): n=c or t
gtcagtgcaattgggacagcaggtcttacattgccngttgcatcaaaattagagaagtatcttataatatc

SEQ ID NO: 44890 - DNA, 71 bp, chicken (Gallus Gallus)
  misc_feature (36): n=a or g
gtaccatctctcactgacctcagaaagtgatccgcncagacttctagatacatgcaataatcataactaac

SEQ ID NO: 44891 - DNA, 71 bp, chicken (Gallus Gallus)
  misc_feature (36): n=c or t
agggactgcttggagtttccctggcatcccagtgantgggataaaagcaactattgtttgcagtttctgag

SEQ ID NO: 44892 - DNA, 71 bp, chicken (Gallus Gallus)
  misc_feature (36): n=c or t
aggccaaaacctcactgttccttgtcctcacagaancaaagctattttggcccggcagcaaactcaactgt

SEQ ID NO: 44893 - DNA, 71 bp, chicken (Gallus Gallus)
  misc_feature (36): n=a or g
agcagctatgaagaaggcaaatcccactacagaatntataacatgaaaaattcccagcagagacaaattag

SEQ ID NO: 44894 - DNA, 71 bp, chicken (Gallus Gallus)
  misc_feature (36): n=c or t
ttctcttgattccaagccaggaaaggagttgcttanattcttgagtaaaacagttaaactgattgacactt

SEQ ID NO: 44895 - DNA, 71 bp, chicken (Gallus Gallus)
  misc_feature (36): n=c or t
gccattgcactcgggtacggtaccatgggcatcacntggaggtaaactcgggcatgggtttggggctgaca

SEQ ID NO: 44896 - DNA, 71 bp, chicken (Gallus Gallus)
  misc_feature (36): n=c or t
gatgaccactaggtgccctcccctgctctatgcagnggtttcagagagggtcccacacgcacatggctact

SEQ ID NO: 44897 - DNA, 71 bp, chicken (Gallus Gallus)
  misc_feature (36): n=a or g
gagcatctggcacacagcacaccctcctcctcccanagttcattgcataaagttcatttgctgcccacctc

SEQ ID NO: 44898 - DNA, 71 bp, chicken (Gallus Gallus)
  misc_feature (36): n=a or g
gctggcagcatgaacagaggctcagtaaccaggctnggtagcacgtggttgaggagtaatgccctcctgac

SEQ ID NO: 44899 - DNA, 71 bp, chicken (Gallus Gallus)
  misc_feature (36): n=a or g
cctcttccaactaataagaagtggtttgggacgccnattgaagagctgaggagaatgcctgtgtgtggggc

SEQ ID NO: 44900 - DNA, 71 bp, chicken (Gallus Gallus)
  misc_feature (36): n=a or g
acagtcagtgggattgcttgaaatgctggtccagangtggctgttctgctgccatgttgcatatggcttat

SEQ ID NO: 44901 - DNA, 71 bp, chicken (Gallus Gallus)
  misc_feature (36): n=c or t
gaaaaggtccacttacagaataagagtttgtgctgnctttacctgagataagaagcagagctctccatttt

SEQ ID NO: 44902 - DNA, 71 bp, chicken (Gallus Gallus)
  misc_feature (36): n=a or g
cattatctaaaaaaagagggcaagctgttggtgctnctggcaactaatgggccagtactaccctcactcct

SEQ ID NO: 44903 - DNA, 71 bp, chicken (Gallus Gallus)
  misc_feature (36): n=a or c
actctgcttcaaaaaaagctgctggatgtcaggaancaatgttaaatgtgcatttcttattttgtggtcag

SEQ ID NO: 44904 - DNA, 71 bp, chicken (Gallus Gallus)
  misc_feature (36): n=a or g
aaaaagctgctggatgtcaggaaccaatgttaaatntgcatttcttattttgtggtcagatcaaaaacaag

SEQ ID NO: 44905 - DNA, 71 bp, chicken (Gallus Gallus)
  misc_feature (36): n=a or g
agacacttcctagtagagtttacccacatgaccttngactgtactgtgggttcaggatagcatgcgttggt

SEQ ID NO: 44906 - DNA, 71 bp, chicken (Gallus Gallus)
  misc_feature (36): n=c or t
ggtacattaccagacaatcactaggctactaatttncatcagttttctgtccagttgtggtttgttcattg

SEQ ID NO: 44907 - DNA, 71 bp, chicken (Gallus Gallus)
  misc_feature (36): n=a or g
ttgcatccaggctgaaaccaaggatgtactgttcantgggttctgctgaggttgctaaaaaagccccacgc

SEQ ID NO: 44908 - DNA, 71 bp, chicken (Gallus Gallus)
  misc_feature (36): n=g or t
agaggtggctgtgaaatatcacagatcttggtctcnattcatcacctggggatttgaaaaccatcacccac

SEQ ID NO: 44909 - DNA, 71 bp, chicken (Gallus Gallus)
  misc_feature (36): n=c or t
catttgcttctcactgcaagttgtagaaatgcatcnaaaactcttgggtattccacgtatggacaagaatg

SEQ ID NO: 44910 - DNA, 71 bp, chicken (Gallus Gallus)
  misc_feature (36): n=c or t
cagacctgttctgctcagagtgaagagaacatcccncaggggtgtactgaacttctttctaggccagcatt

SEQ ID NO: 44911 - DNA, 71 bp, chicken (Gallus Gallus)
  misc_feature (36): n=c or t
actgtaataagcctcatggaaatctgtgtgaagatnaccctgtgaagccccagataaagcctggcgtattc

SEQ ID NO: 44912 - DNA, 71 bp, chicken (Gallus Gallus)
  misc_feature (36): n=a or g
tggaagatctcgattaagtcagctgccaggtacacntgtaccacattacaggaggtgaaattcagcactca

SEQ ID NO: 44913 - DNA, 71 bp, chicken (Gallus Gallus)
  misc_feature (36): n=a or g
ccatgttcctaaatgaccctcatgatctttgtttgnggacccttcattcgacatttaactgaagcagcatt

SEQ ID NO: 44914 - DNA, 71 bp, chicken (Gallus Gallus)
  misc_feature (36): n=a or g
gctgtagtttgtagatggtgatgattgttgcttctnttcccacagtcctctttgagttttgttctctgaca

SEQ ID NO: 44915 - DNA, 71 bp, chicken (Gallus Gallus)
  misc_feature (36): n=a or c
cactttaagcggatttcggagtatcagctaaaaacncaagaaccatacaaagaagggattccttcatcggt

SEQ ID NO: 44916 - DNA, 71 bp, chicken (Gallus Gallus)
  misc_feature (36): n=a or g
ttccagatagcaactgcagttccccatgtgccttgnttttgcatgctagggccaagcagcaacacaaccaa

SEQ ID NO: 44917 - DNA, 71 bp, chicken (Gallus Gallus)
  misc_feature (36): n=c or t
ttagtcaacctcacacccctgacgctgctgtttttnctaccatctccctatcaatatttacagagcaaaag

SEQ ID NO: 44918 - DNA, 71 bp, chicken (Gallus Gallus)
  misc_feature (36): n=a or g
atttccattctcacaaacaatttcgttttatttccnttcagttataatcctgtcccgaaatgctgggttgc

SEQ ID NO: 44919 - DNA, 71 bp, chicken (Gallus Gallus)
  misc_feature (36): n=g or t
ttgttctcttgatgtaagagtgcttgaatcaagttngttttatttctcatttatgtttgaatggaaattca

SEQ ID NO: 44920 - DNA, 71 bp, chicken (Gallus Gallus)
  misc_feature (36): n=a or g
tggtttagcatgtagcctcaatttagaaaagtcatnagggacatctgggccctgatgcctggggaattact

SEQ ID NO: 44921 - DNA, 71 bp, chicken (Gallus Gallus)
  misc_feature (36): n=g or t
attgccattccagtaatagcctgtgtacgacatganagacaccagcgttcagctgagtatggaggtgcgtt

SEQ ID NO: 44922 - DNA, 71 bp, chicken (Gallus Gallus)
  misc_feature (36): n=a or g
ctcttatagaggacagaatcattgtgaactcatgangtagaagcagagtggacatataggtgatgactgtg

SEQ ID NO: 44923 - DNA, 71 bp, chicken (Gallus Gallus)
  misc_feature (36): n=c or t
tcgtccaggatgtgtatcttagtatatgttagctgnaactccagggctaccccaagctgccatccctgctc

SEQ ID NO: 44924 - DNA, 71 bp, chicken (Gallus Gallus)
  misc_feature (36): n=a or c
cctctccctgtgacctggagaagcttcaaaattttnatgtccaaacagttaagcacagcaagaccacctgt

SEQ ID NO: 44925 - DNA, 71 bp, chicken (Gallus Gallus)
  misc_feature (36): n=c or t
tccttatagtaagctctaagaagcctggaataccancttgatatagcaaaacactagtatctctaggagaa

SEQ ID NO: 44926 - DNA, 71 bp, chicken (Gallus Gallus)
  misc_feature (36): n=a or g
ctgtggtggacatctggataggacagctcttggctnaaatgtttatgaatgcaatggatgctgctgagaaa

SEQ ID NO: 44927 - DNA, 71 bp, chicken (Gallus Gallus)
  misc_feature (36): n=a or g
ttttttattttttaattcttctgctccattgtcctntgaaaggaagaggaaacatgcttgggataatacag

SEQ ID NO: 44928 - DNA, 71 bp, chicken (Gallus Gallus)
  misc_feature (36): n=c or t
tcatttaaatgaagataaaaggagaaccagctgtancagcacaaagactgcagatctgcatcaaggcttct

SEQ ID NO: 44929 - DNA, 71 bp, chicken (Gallus Gallus)
  misc_feature (36): n=a or g
tggctgcatagcacacttagtgtcagagtattctcncacttcaagctcactacaacttttcccttatatgg

SEQ ID NO: 44930 - DNA, 71 bp, chicken (Gallus Gallus)
  misc_feature (36): n=c or t
tattaaaaattaacagcaccagtaaagctggagttngtctgcattgattttacagaccccactgtggctct

SEQ ID NO: 44931 - DNA, 71 bp, chicken (Gallus Gallus)
  misc_feature (36): n=g or t
gggatgcagtcagctggtatgaagtgctaattaagncaccattatagtggattcattcactgttccagtct

SEQ ID NO: 44932 - DNA, 71 bp, chicken (Gallus Gallus)
  misc_feature (36): n=a or g
tctccaaggggtacggagcggattcaagggatgccntgtggctccttgaacccagtggctgtgctgtcact

SEQ ID NO: 44933 - DNA, 71 bp, chicken (Gallus Gallus)
  misc_feature (36): n=a or g
tgagacgtaaattatttcctctctcttacaagttcntttcattaggattattttggcaagaaaaaaaaaga

SEQ ID NO: 44934 - DNA, 71 bp, chicken (Gallus Gallus)
  misc_feature (36): n=a or c
ccatttaatgcagcatcaaatgcaagcagtgcctcncagcatgagaaagtgcagggcccagtgagatgaga

SEQ ID NO: 44935 - DNA, 71 bp, chicken (Gallus Gallus)
  misc_feature (36): n=c or t
ggtggaggcagagaaatgctacaacctgtttgctcngctgagctccttgcaccagcaccaactccagctct

SEQ ID NO: 44936 - DNA, 71 bp, chicken (Gallus Gallus)
  misc_feature (36): n=a or g
gacagagctttattgcacttttgcctaaagagaagntgaataaccgagtcacaccagaaatctgaatcagt

SEQ ID NO: 44937 - DNA, 71 bp, chicken (Gallus Gallus)
  misc_feature (36): n=c or t
catgaaaacactgcttgtagaaagcttgaagcttanatcaggtttaatcttgttgggtgcacagcttccta

SEQ ID NO: 44938 - DNA, 71 bp, chicken (Gallus Gallus)
  misc_feature (36): n=c or t
tccttcctcaaatcagcactaagttaagctaaagcntgattgttacatggcattcacatgtaaaataactt

SEQ ID NO: 44939 - DNA, 71 bp, chicken (Gallus Gallus)
  misc_feature (36): n=a or g
ccttttctttttgtgacaaagttattgttttctggngaaatgtcctccaggtctaactatgagaagttgca

SEQ ID NO: 44940 - DNA, 71 bp, chicken (Gallus Gallus)
  misc_feature (36): n=a or g
accaaaaaccaaaactacaacaccagggctttagtngaacatcaaaatcaaacagcttaagaaaaaaagaa

SEQ ID NO: 44941 - DNA, 71 bp, chicken (Gallus Gallus)
  misc_feature (36): n=a or g
ttgattgaagtaatccaagaactgaagcagaacccnacatgctcttatgaacccataaaatgcttcagagg

SEQ ID NO: 44942 - DNA, 71 bp, chicken (Gallus Gallus)
  misc_feature (36): n=a or g
acagctcagattttaatgtctgcctatgtatactgnatataatttcagcaaccagaaactttgtacttcgg

SEQ ID NO: 44943 - DNA, 71 bp, chicken (Gallus Gallus)
  misc_feature (36): n=g or t
tgtctttgattcctcagccaaactgcatataacttnaatgcttcttgtattttatgaactttctgatgatg

SEQ ID NO: 44944 - DNA, 71 bp, chicken (Gallus Gallus)
  misc_feature (36): n=c or t
taaattctacgcatcccatttctttcattatttgcngctcttctgcacagttggtctggctttatcctcct

SEQ ID NO: 44945 - DNA, 71 bp, chicken (Gallus Gallus)
  misc_feature (36): n=a or c
ttggagcaccagtgtctttacttgataaacaaatcnaaattgttcagatgaaagcttaactctggaaaaaa

SEQ ID NO: 44946 - DNA, 71 bp, chicken (Gallus Gallus)
  misc_feature (36): n=a or g
atgctaacggggtatgtattcaagccacaaatggtnatgtgacccatattctgttgctcctccccacaata

SEQ ID NO: 44947 - DNA, 71 bp, chicken (Gallus Gallus)
  misc_feature (36): n=a or g
gtgactacacgtatgctcatcagctggagaaagaangatgttgactgtcacaccaatgcacttgacttttt

SEQ ID NO: 44948 - DNA, 71 bp, chicken (Gallus Gallus)
  misc_feature (36): n=a or c
aaagagatttttgcactaacaagtgtgaactgatangtttgacctgtatgggaaatgtagagaatccttag

SEQ ID NO: 44949 - DNA, 71 bp, chicken (Gallus Gallus)
  misc_feature (36): n=a or g
aatcgaaatgtgtggtgtttttagtttctccctgcntgtgcttgatttaagtagatgagtggtatctgtat

SEQ ID NO: 44950 - DNA, 71 bp, chicken (Gallus Gallus)
  misc_feature (36): n=a or g
ctcagcacagagaacagctagagataccaagagaanccttgctttgtttacatcacatgaatctgcacagg

SEQ ID NO: 44951 - DNA, 71 bp, chicken (Gallus Gallus)
  misc_feature (36): n=c or t
gaatgaatgaggagagaaaactaagataatgtagtngataatcagttcaaggcagagcattatccatgggg

SEQ ID NO: 44952 - DNA, 71 bp, chicken (Gallus Gallus)
  misc_feature (36): n=a or g
ttatgggattggggaacataacttctgcaggtaacnttttgaagagccagttgtatcaaatagatcttcga

SEQ ID NO: 44953 - DNA, 71 bp, chicken (Gallus Gallus)
  misc_feature (36): n=c or t
cctccatctcaagatctgctctgttttcctacactnctatataggaacagtgatagaatcagagtgtgttt

SEQ ID NO: 44954 - DNA, 71 bp, chicken (Gallus Gallus)
  misc_feature (36): n=a or c
gccttcaaataaagcctcaattagcttgcttacgcnactaaaagcagcatgggatgagttccctggcaggc

SEQ ID NO: 44955 - DNA, 71 bp, chicken (Gallus Gallus)
  misc_feature (36): n=c or t
atttctgaaagcagtgttaaagcctaccaaccaagnccaagtgaaaaatctctatgagctcagtcacaaaa

SEQ ID NO: 44956 - DNA, 71 bp, chicken (Gallus Gallus)
  misc_feature (36): n=a or g
gggtttattaagatatgtagatttggcactcattgntctggcttatggttgccaaaatgtggacagctcta

SEQ ID NO: 44957 - DNA, 71 bp, chicken (Gallus Gallus)
  misc_feature (36): n=a or g
ttccagaaaaacaagactggtagttaatcgatcgtnagattatcagtgagaaactgttcaatgcatctccc

SEQ ID NO: 44958 - DNA, 71 bp, chicken (Gallus Gallus)
  misc_feature (36): n=c or t
tttttgatagagttcattatgcaaggcggtgataanagctgcagaggaacgaatacgatttcacttaataa

SEQ ID NO: 44959 - DNA, 71 bp, chicken (Gallus Gallus)
  misc_feature (36): n=a or g
tctcttggacccaccgtaacaccagcctttgttctncattgcttcctttataaaagctctttaacatttca

SEQ ID NO: 44960 - DNA, 71 bp, chicken (Gallus Gallus)
  misc_feature (36): n=c or t
aatcatcatcgtaagctacaaatgcacatctgtgcntttaatctaccatgcccccattttgatgccaggtc

SEQ ID NO: 44961 - DNA, 71 bp, chicken (Gallus Gallus)
  misc_feature (36): n=a or g
caaacacctgcctggaacaatatattatcacagtgnatctgtaatgtttctgttttaccagatgaagacac

SEQ ID NO: 44962 - DNA, 71 bp, chicken (Gallus Gallus)
  misc_feature (36): n=c or t
tgcactttgatagatgacacccaaatcttttcaatntttattctgtgagtaaattttcctgcagcaaattt

SEQ ID NO: 44963 - DNA, 71 bp, chicken (Gallus Gallus)
  misc_feature (36): n=c or t
ttcagtattaaaaatgttggattttgaaaataatcnggttgaattgtgagcacagaatgcttttgaatggg

SEQ ID NO: 44964 - DNA, 71 bp, chicken (Gallus Gallus)
  misc_feature (36): n=a or c
cattcattttgtaacaggcaggtgttcacacacaancctggacatgaaacagcctttttattcaaggcatt

SEQ ID NO: 44965 - DNA, 71 bp, chicken (Gallus Gallus)
  misc_feature (36): n=c or t
gatgataacacttcagcttccttgctgaaaagccanggtagaatgaggttgagttttgctctggctgtaat

SEQ ID NO: 44966 - DNA, 71 bp, chicken (Gallus Gallus)
  misc_feature (36): n=c or t
ctaaacaataggtactaccacttggccctggatgtngttaatgtactgcacgcaagttaatttgggaaaaa

SEQ ID NO: 44967 - DNA, 71 bp, chicken (Gallus Gallus)
  misc_feature (36): n=c or t
gcttatgcgacactggttttgtacagctggtcttcnacattaatactgattgtctgttacatgtcaatatt

SEQ ID NO: 44968 - DNA, 71 bp, chicken (Gallus Gallus)
  misc_feature (36): n=g or t
ccttttttgtggatcagtaacttagatatggaagtnctacatatccttatttcagtcacagctgatccttt

SEQ ID NO: 44969 - DNA, 71 bp, chicken (Gallus Gallus)
  misc_feature (36): n=c or t
tatctgccctttgaaaacaagcatgacttccttttntttggctaagtttggtagaataaaagctgtcagtc

SEQ ID NO: 44970 - DNA, 71 bp, chicken (Gallus Gallus)
  misc_feature (36): n=c or t
cccagaccaaaatacagacctagtccaatgtcttantgcatgccagcatggctgcaacccctcacctcttc

SEQ ID NO: 44971 - DNA, 71 bp, chicken (Gallus Gallus)
  misc_feature (36): n=c or t
tttaccattaccatctttaacacatctctagctctnctattttttcatatgtaaacaatgtagttcttcct

SEQ ID NO: 44972 - DNA, 71 bp, chicken (Gallus Gallus)
  misc_feature (36): n=a or g
atttaatgcttctgaaagaagtcactgtagtatcantgcaaattattaatttatgaatgtgattttctagt

SEQ ID NO: 44973 - DNA, 71 bp, chicken (Gallus Gallus)
  misc_feature (36): n=a or g
gtaatctcatctgcaaggctgccccagaatagcatncaacgggctgggttcagatccttgtgtacagagcc

SEQ ID NO: 44974 - DNA, 71 bp, chicken (Gallus Gallus)
  misc_feature (36): n=a or g
gtgaataattctgctcttgtgtcacttagctaaaanaaaacctgaactcaaacaccacctcgagcagtgaa

SEQ ID NO: 44975 - DNA, 71 bp, chicken (Gallus Gallus)
  misc_feature (36): n=c or t
aagagtggataactgtctggaaaggaatccatcagngcacatagtaaggagtatgctgtgccacagcaaaa

SEQ ID NO: 44976 - DNA, 71 bp, chicken (Gallus Gallus)
  misc_feature (36): n=a or c
caaaatcctctctcaaatccctttgaggcagacttngaaggaatttcctgttttaatacccactgccatcc

SEQ ID NO: 44977 - DNA, 71 bp, chicken (Gallus Gallus)
  misc_feature (36): n=a or g
aaaaaaatccctgggttagatatatatgagccttcntacagatacacggcttgtgaattaagtcttcctta

SEQ ID NO: 44978 - DNA, 71 bp, chicken (Gallus Gallus)
  misc_feature (36): n=a or g
aagatccttttcactgtcaattcaccacgcattctntaagaccttggggcctgcaattatttcatttcctt

SEQ ID NO: 44979 - DNA, 71 bp, chicken (Gallus Gallus)
  misc_feature (36): n=c or t
ttaaaaacactattcttttcagcaatatgttgtacnccttcactgaggctaacatattcagacagacaaca

SEQ ID NO: 44980 - DNA, 71 bp, chicken (Gallus Gallus)
  misc_feature (36): n=a or g
ataaagcgaagtctccgctggttattgcacggctcngggtcacaccggtgggatccgcacagcacctcgag

SEQ ID NO: 44981 - DNA, 71 bp, chicken (Gallus Gallus)
  misc_feature (36): n=g or t
atccccgggtataataatcacttcaactgcagatantttaagaggaatagctcaatactggttttgtatta

SEQ ID NO: 44982 - DNA, 71 bp, chicken (Gallus Gallus)
  misc_feature (36): n=a or g
aatctccagtgacagatgtgctccctgagtgaatgntttaacgctctgatccaaacagtgattctttaaaa

SEQ ID NO: 44983 - DNA, 71 bp, chicken (Gallus Gallus)
  misc_feature (36): n=a or c
ttttcatggatctagatttatattcacacgcctagnagtcagacatatattgagctaaatatattgccaac

SEQ ID NO: 44984 - DNA, 71 bp, chicken (Gallus Gallus)
  misc_feature (36): n=a or g
aatacggtgagtagccacacctgagtaattaaagancttgtttttacagggaagcactaagtttattaagc

SEQ ID NO: 44985 - DNA, 71 bp, chicken (Gallus Gallus)
  misc_feature (36): n=c or t
acaaacaaacaaacccaccagtatatcaccccctcnccccaaataacaatatgttaatcctttgcacagtg

SEQ ID NO: 44986 - DNA, 71 bp, chicken (Gallus Gallus)
  misc_feature (36): n=g or t
cctccttcagacctctacctcccacacagctgttantttcagccaagagtgtaatctagaaaataagtaac

SEQ ID NO: 44987 - DNA, 71 bp, chicken (Gallus Gallus)
  misc_feature (36): n=c or t
cactgagccagaggagccaaaatttcacttggaagntgttaccagacttaatcacagtcaatgtaagtgag

SEQ ID NO: 44988 - DNA, 71 bp, chicken (Gallus Gallus)
  misc_feature (36): n=a or g
ctccagaatcagaacctggcccaagaactgcaggcnttgcattcaggaggcagacactttaaagaggagtc

SEQ ID NO: 44989 - DNA, 71 bp, chicken (Gallus Gallus)
  misc_feature (36): n=a or g
tctctcaaaaacataatatctgtactacattgtgcnagatgaaggttagattacatttcttgccagtgcag

SEQ ID NO: 44990 - DNA, 71 bp, chicken (Gallus Gallus)
  misc_feature (36): n=a or c
gcagaaacagaatagacagtttaacaattgcataanatgagatcctgcagaactgctctaagttttccagg

SEQ ID NO: 44991 - DNA, 71 bp, chicken (Gallus Gallus)
  misc_feature (36): n=c or t
cccaatctcatacatctgaatgactcagcacttacncttagcaaaaacagctgtcattatttgaaaccaca

SEQ ID NO: 44992 - DNA, 71 bp, chicken (Gallus Gallus)
  misc_feature (36): n=a or g
ggtaaagatctagcatcatgcttagccttacacccnagtgactacatcaccaaaaggtatgaagagcaaag

SEQ ID NO: 44993 - DNA, 71 bp, chicken (Gallus Gallus)
  misc_feature (36): n=a or c
aaacagaatagtgttactaacctcatagaatggccncttctgtgttagatcagtactgaagtgctggggtt

SEQ ID NO: 44994 - DNA, 71 bp, chicken (Gallus Gallus)
  misc_feature (36): n=a or g
agcaaatgttcaggggatggagatgctcaaaggatngagatacagcagcaacagtcccagctcctctgcct

SEQ ID NO: 44995 - DNA, 71 bp, chicken (Gallus Gallus)
  misc_feature (36): n=c or t
attttcaaaataagcaagtgattaatgccaattctngtccagagaaaggaatagaagggacacgatctgtt

SEQ ID NO: 44996 - DNA, 71 bp, chicken (Gallus Gallus)
  misc_feature (36): n=a or g
tgtcttcatgtagatttgttgagcttcaaactatcngtgctcactgtgtatcagaattgagttctatgcag

SEQ ID NO: 44997 - DNA, 71 bp, chicken (Gallus Gallus)
  misc_feature (36): n=c or t
tgaaatatacggggtgcttctgggagaggagacaanacaaatttctgccaagtctgagtcttaattactgg

SEQ ID NO: 44998 - DNA, 71 bp, chicken (Gallus Gallus)
  misc_feature (36): n=g or t
tgaactactaagtcacgacaggactgaacaggaacnattcttcacttggaggactgcaggactggctgtaa

SEQ ID NO: 44999 - DNA, 71 bp, chicken (Gallus Gallus)
  misc_feature (36): n=a or g
caacagctgcatccatcaaacgcagacaggaaaatncacaactcacgaccagaactcacagctctggccct

SEQ ID NO: 45000 - DNA, 71 bp, chicken (Gallus Gallus)
  misc_feature (36): n=c or t
tttgatgcaacaattcagttttctgatcactgtagngtgcattaacaccctaaaatgtttaaggaaaactt

SEQ ID NO: 45001 - DNA, 71 bp, chicken (Gallus Gallus)
  misc_feature (36): n=c or t
gtaatttcagatatggagaaagagaattggcaaaanttaatcttagcttcttattccttctatatggtcat

SEQ ID NO: 45002 - DNA, 71 bp, chicken (Gallus Gallus)
  misc_feature (36): n=g or t
gtgctttggttcctctgctaaagaggaacatttcanttctaagaggctgagggctcaagtgtacaacagac

SEQ ID NO: 45003 - DNA, 71 bp, chicken (Gallus Gallus)
  misc_feature (36): n=a or g
gctatagctgcctgagtttcatctttaaagcagatncaattttagagatacacataatactctgctactgg

SEQ ID NO: 45004 - DNA, 71 bp, chicken (Gallus Gallus)
  misc_feature (36): n=g or t
atgtaaaacacgcaaattgctccagtgaaaaatgtncagatgatatacagactaatccaactcgagaatcc

SEQ ID NO: 45005 - DNA, 71 bp, chicken (Gallus Gallus)
  misc_feature (36): n=a or g
gagtataaggattttctgttttatgcatattgtgtnacaactactggagctcctaataaaatgtagtgatc

SEQ ID NO: 45006 - DNA, 71 bp, chicken (Gallus Gallus)
  misc_feature (36): n=a or g
gcactttcagtggcaaagtgatgctccagcactgcnaaaacatgtagctggcattacaatcatgccaactt

SEQ ID NO: 45007 - DNA, 71 bp, chicken (Gallus Gallus)
  misc_feature (36): n=a or g
agatcactcaaaattgttgtcataatagatacaacngtataaccaggttggctggtatcatccaaaacatc

SEQ ID NO: 45008 - DNA, 71 bp, chicken (Gallus Gallus)
  misc_feature (36): n=c or t
tgatttccaccctgacattagtacatgggatgacanggaaagagatgaaagaagacttacttttaacttga

SEQ ID NO: 45009 - DNA, 71 bp, chicken (Gallus Gallus)
  misc_feature (36): n=g or t
tgtacttccacagttcttgcagtactagttccaaangcaaagcatgtgtttgtaaatatgggatttcagtt

SEQ ID NO: 45010 - DNA, 71 bp, chicken (Gallus Gallus)
  misc_feature (36): n=c or t
tatcatagcataccaggtccatttcttgtatgagantggggaggattggagcagatttgtttgctttttaa

SEQ ID NO: 45011 - DNA, 71 bp, chicken (Gallus Gallus)
  misc_feature (36): n=a or g
gttaagaaacgtagttgtgcccttgcttattcagcngctcattttgcctgtttgtctaacaccattttcta

SEQ ID NO: 45012 - DNA, 71 bp, chicken (Gallus Gallus)
  misc_feature (36): n=a or g
ttcatgatttcactacagtttaaaagtgatgcttcntagaacaaatcagctcagcactaagaaatgtgaaa

SEQ ID NO: 45013 - DNA, 71 bp, chicken (Gallus Gallus)
  misc_feature (36): n=a or g
tcttacctatgtactgagagcacgctactcatggcntgcaacttcatctcccagtttgaaagctttcagag

SEQ ID NO: 45014 - DNA, 71 bp, chicken (Gallus Gallus)
  misc_feature (36): n=a or g
tcatcttgtcttctgtccattcatggaacaatagtncatttgtgctggtatcaaacaaagcatttggttcc

SEQ ID NO: 45015 - DNA, 71 bp, chicken (Gallus Gallus)
  misc_feature (36): n=c or t
tatacctacaccagctttttctatgtgacgccttcngaagctatttcagtggcagaactgtggtagcacgt

SEQ ID NO: 45016 - DNA, 71 bp, chicken (Gallus Gallus)
  misc_feature (36): n=a or g
gtcaccttggcactggtttgtgggacaggttaaaangacacctgtccaaaggcagcttgtcagcctacaaa

SEQ ID NO: 45017 - DNA, 71 bp, chicken (Gallus Gallus)
  misc_feature (36): n=a or g
tccctgttcttaaattgatggcagagagcctaaacnaaaacatttcattatggattgtctataggcagtga

SEQ ID NO: 45018 - DNA, 71 bp, chicken (Gallus Gallus)
  misc_feature (36): n=c or t
ttgaaacaaagatgcatttacatgcaagaactgagntcaaatgacttctatttttggagatatcactgctt

SEQ ID NO: 45019 - DNA, 71 bp, chicken (Gallus Gallus)
  misc_feature (36): n=c or t
ttctgtcttctcagatgttatcagggcacagcctgnagtgccggtgctgggcgtgggctgctgtggggtgc

SEQ ID NO: 45020 - DNA, 71 bp, chicken (Gallus Gallus)
  misc_feature (36): n=a or c
ctgctgctcccctttctctttgagctcctgggcagnctaggaagtgcgtttttggaagctgaccctgtgcg

SEQ ID NO: 45021 - DNA, 71 bp, chicken (Gallus Gallus)
  misc_feature (36): n=a or g
cagagcattttacaaggagttgtcttctctgaaatntaactccatagtctaagtggaagggaatggttgga

SEQ ID NO: 45022 - DNA, 71 bp, chicken (Gallus Gallus)
  misc_feature (36): n=a or g
gatagcaagcaaaaaattaaacgaatgatacatacncatgtagacatttcattccattaaaagccacttct

SEQ ID NO: 45023 - DNA, 71 bp, chicken (Gallus Gallus)
  misc_feature (36): n=a or c
tgggttgtatttaaataaaggggattttcttttgcngcagtgcttggaatttacgattgagtaaaactcag

SEQ ID NO: 45024 - DNA, 71 bp, chicken (Gallus Gallus)
  misc_feature (36): n=c or t
aaagtcctactgccaggctttgataactttccgtcnggctcccgatttttcacgctgaccccaaaaacgcc

SEQ ID NO: 45025 - DNA, 71 bp, chicken (Gallus Gallus)
  misc_feature (36): n=c or t
ccagaatgagcattctgcacagctcgttgcatccangcttttttacattgccactttatttcctgacaagc

SEQ ID NO: 45026 - DNA, 71 bp, chicken (Gallus Gallus)
  misc_feature (36): n=c or t
tctgcttgattgggtatgacttaacctagtagatanaccagtcagcccggacagcgcaccgaatcacacct

SEQ ID NO: 45027 - DNA, 71 bp, chicken (Gallus Gallus)
  misc_feature (36): n=a or g
agggtgtcttcaccccgctccatgcaacacagaccntatttcagaggaatcacatttgattagtttcactg

SEQ ID NO: 45028 - DNA, 71 bp, chicken (Gallus Gallus)
  misc_feature (36): n=a or g
taggatctatagggatcaaagagcataggatctatngggagacaccagggcaaacctcaggatctccctcc

SEQ ID NO: 45029 - DNA, 71 bp, chicken (Gallus Gallus)
  misc_feature (36): n=a or c
tactttaattaaactcactgagcctttgaagttttntattaaataaaagcatatcttgcacaccaggtggg

SEQ ID NO: 45030 - DNA, 71 bp, chicken (Gallus Gallus)
  misc_feature (36): n=a or g
gacgagtcacctcagcacaaatcccagactgctccngtgtgtcaaaagtcatcgaaatgggttaggtaaca

SEQ ID NO: 45031 - DNA, 71 bp, chicken (Gallus Gallus)
  misc_feature (36): n=a or c
cacagctctgtgcccacacagcgtgcagaggccttnctggagtgcttcagctgctctcgtaaatgagctgt

SEQ ID NO: 45032 - DNA, 71 bp, chicken (Gallus Gallus)
  misc_feature (36): n=g or t
ctgtattttccgcagctgtcgagtaacagtactgcnctggcctcctactctgcttacaagcagcacaaaat

SEQ ID NO: 45033 - DNA, 71 bp, chicken (Gallus Gallus)
  misc_feature (36): n=a or g
tggttatcttttaatatgttaataacacttctaacnctcttccccccttgttcctttatgtagttttaaaa

SEQ ID NO: 45034 - DNA, 71 bp, chicken (Gallus Gallus)
  misc_feature (36): n=a or c
cagatgtaactgaaatgcttcccattcacagcattnaacagtgaaattcaccatcgctgtgccttcaatta

SEQ ID NO: 45035 - DNA, 71 bp, chicken (Gallus Gallus)
  misc_feature (36): n=a or g
actcaaaccccacattattactgacaatcagtgacntttaaccgaatcagaaaaacactgctggtagcgct

SEQ ID NO: 45036 - DNA, 71 bp, chicken (Gallus Gallus)
  misc_feature (36): n=a or g
aaaagtgtccatgacatcaactacatacaaatgacnctcttaatatatgacctggggtggggtctggtggt

SEQ ID NO: 45037 - DNA, 71 bp, chicken (Gallus Gallus)
  misc_feature (36): n=a or g
ttgtcacacttgaattagtactctacccttgcttgncatcatttcatagtgaccagtttttgacaactgcc

SEQ ID NO: 45038 - DNA, 71 bp, chicken (Gallus Gallus)
  misc_feature (36): n=c or t
tgcagcacaaagcagccaaggcaagggattgaagcncttcctgtatctttgcagcaggatggatgcagacc

SEQ ID NO: 45039 - DNA, 71 bp, chicken (Gallus Gallus)
  misc_feature (36): n=a or c
agaaggaatgatgggttgaagatgggagaggtctangaggacgtgtttccttccctttgcaaggacccctt

SEQ ID NO: 45040 - DNA, 71 bp, chicken (Gallus Gallus)
  misc_feature (36): n=g or t
catccatccactttgtgctctggggtgaaatacttnctctgttacatggatctggatggtttctgtgcata

SEQ ID NO: 45041 - DNA, 71 bp, chicken (Gallus Gallus)
  misc_feature (36): n=a or g
ttgcatatcaatgaaagggttaatttggttccaatngaaaactcaattttccaatcagctcatgaaaacac

SEQ ID NO: 45042 - DNA, 71 bp, chicken (Gallus Gallus)
  misc_feature (36): n=c or t
ggcagactggcccaactgcaccccatattcaggtgnccacccatacaggtcttccatttcaatctgagaaa

SEQ ID NO: 45043 - DNA, 71 bp, chicken (Gallus Gallus)
  misc_feature (36): n=a or g
atccaatagagaatattctgcatttcaatataaaangaatctggtggagattgctcctgagctggaaatga

SEQ ID NO: 45044 - DNA, 71 bp, chicken (Gallus Gallus)
  misc_feature (36): n=a or c
tgctaaaaatatgctttaagggatcctcaaagaaanctttttggagtctttggaagttgaattttagtatc

SEQ ID NO: 45045 - DNA, 71 bp, chicken (Gallus Gallus)
  misc_feature (36): n=a or g
gaaacgccttgaataatgagagcaaaacagaaacgntggctaagaacttctagagagagaattaacagact

SEQ ID NO: 45046 - DNA, 71 bp, chicken (Gallus Gallus)
  misc_feature (36): n=c or t
agttaaaaacaaggtacttatcccaggcattagatnggtactatcacacttagcctctactcagcaaagct

SEQ ID NO: 45047 - DNA, 71 bp, chicken (Gallus Gallus)
  misc_feature (36): n=a or g
agggtagattatagccataatccatcagaaattctntaacatgatgtattcagccttcctggatatccatc

SEQ ID NO: 45048 - DNA, 71 bp, chicken (Gallus Gallus)
  misc_feature (36): n=g or t
cctgaagtcaatgaaagttcctattctttcctattnccaactgcttacataaaatcggcagaaatgctttt

SEQ ID NO: 45049 - DNA, 71 bp, chicken (Gallus Gallus)
  misc_feature (36): n=c or t
ggcacagagcctttaagggtttacagattgcactgnagtcacatccagcagggacacttctcagttctgct

SEQ ID NO: 45050 - DNA, 71 bp, chicken (Gallus Gallus)
  misc_feature (36): n=a or g
ttttcggtgtctgtaacacacgggtaatgtgcaggnggcttaattagagcgagtcaatcatgattcaatct

SEQ ID NO: 45051 - DNA, 71 bp, chicken (Gallus Gallus)
  misc_feature (36): n=a or g
attttcaataatatcacaatatggaactaacactgnctgtccagttgagagcaatatattactgtatgttt

SEQ ID NO: 45052 - DNA, 71 bp, chicken (Gallus Gallus)
  misc_feature (36): n=a or c
aaatattgctctggggtatggctgcaaggggacctntgtgcttcacgtttccagagcaccagagcaacctc

SEQ ID NO: 45053 - DNA, 71 bp, chicken (Gallus Gallus)
  misc_feature (36): n=a or g
tgcccgtgctcgccctcgtgccagcacagcactcancatttgtcaaacatgtgcaaggagagcagcctgag

SEQ ID NO: 45054 - DNA, 71 bp, chicken (Gallus Gallus)
  misc_feature (36): n=c or t
actgagtcctcctgctgtgcccagcacaaaggatancttggcatcctccatccccaaatgtttattaacca

SEQ ID NO: 45055 - DNA, 71 bp, chicken (Gallus Gallus)
  misc_feature (36): n=a or g
cattgtactgaacttttgttactcctgcttaaaacntgggcaatgtctgtgcatgttccaggctgtggttt

SEQ ID NO: 45056 - DNA, 71 bp, chicken (Gallus Gallus)
  misc_feature (36): n=a or g
tgttggtattgctaaagcagtgtgaattggagggcngacagcactgcacactcatggctcggctgcttgct

SEQ ID NO: 45057 - DNA, 71 bp, chicken (Gallus Gallus)
  misc_feature (36): n=c or t
catgtttggcgaggaattaaataagtgaatatcagnagctgaactgctggcagaggagccaaaccctcttg

SEQ ID NO: 45058 - DNA, 71 bp, chicken (Gallus Gallus)
  misc_feature (36): n=c or t
cagattctgaaatattgcctaagcccctgtcagctngaaggtgatttctccaggtcatggtttgggggaat

SEQ ID NO: 45059 - DNA, 71 bp, chicken (Gallus Gallus)
  misc_feature (36): n=c or t
gaggagcaccaggcatttgcagtcagtgcctcatgnttcagcagtgcactgggcactgccctgtgcccacc

SEQ ID NO: 45060 - DNA, 71 bp, chicken (Gallus Gallus)
  misc_feature (36): n=a or c
tatgttgaaagcaagtgtttctaaattttggaaacngagttgactattattagcgctcataaagattaaga

SEQ ID NO: 45061 - DNA, 71 bp, chicken (Gallus Gallus)
  misc_feature (36): n=a or g
aatacaatttcactttgctgcatagcggcattaagntaattagaactggtctaagcttttgggccatttaa

SEQ ID NO: 45062 - DNA, 71 bp, chicken (Gallus Gallus)
  misc_feature (36): n=a or c
cttatccactaccagtgagtgctgttttttggccantgatttcccattggtcagagggtaaatactgctcc

SEQ ID NO: 45063 - DNA, 71 bp, chicken (Gallus Gallus)
  misc_feature (36): n=a or c
cagccaaaccaccagcacctacatgcaatgttctcnccatactccatcttagggttgttctagcaggcaca

SEQ ID NO: 45064 - DNA, 71 bp, chicken (Gallus Gallus)
  misc_feature (36): n=g or t
ctgctgaagtagctgggccagagctgataaagttgnctcaacatttggttattcagatggtgcagacacag

SEQ ID NO: 45065 - DNA, 71 bp, chicken (Gallus Gallus)
  misc_feature (36): n=a or g
aggtcttgagcgatttgaggtgcttttcaggacagngattagtgtcctgagaaagaaatgagggaaaacct

SEQ ID NO: 45066 - DNA, 71 bp, chicken (Gallus Gallus)
  misc_feature (36): n=g or t
aaagactcagaggaaaggtacaaccatgaacctggngagaagtcatgctttatggctagcccagtgcatta

SEQ ID NO: 45067 - DNA, 71 bp, chicken (Gallus Gallus)
  misc_feature (36): n=a or g
tcacctaaaatccctcattgcatcacccgtggcaantattttcaagagaaaacaaaatcctcatttgcagt

SEQ ID NO: 45068 - DNA, 71 bp, chicken (Gallus Gallus)
  misc_feature (36): n=c or t
atctcagatttgccttgtccttcactaccagtcagngtcctcaactttctcagtttagtgggcacagtggt

SEQ ID NO: 45069 - DNA, 71 bp, chicken (Gallus Gallus)
  misc_feature (36): n=c or t
gttctaagttagctaaaggtgtagtcaaagaaactngaaatactctatttccatggttctttttcttttcc

SEQ ID NO: 45070 - DNA, 71 bp, chicken (Gallus Gallus)
  misc_feature (36): n=g or t
acattgtttcctaccaacagcttccttcatttcttnagctgcatgttgcctttgtttgaaggtatcgttag

SEQ ID NO: 45071 - DNA, 71 bp, chicken (Gallus Gallus)
  misc_feature (36): n=a or g
atttactgacagaagagctactgttcggattcttgngggtctgcagagtgactcaagactttgtccaaatg

SEQ ID NO: 45072 - DNA, 71 bp, chicken (Gallus Gallus)
  misc_feature (36): n=a or g
agaggaagctttagctcattttcctaataatgatcnttcatttggactcaacatgatccagccctaagcat

SEQ ID NO: 45073 - DNA, 71 bp, chicken (Gallus Gallus)
  misc_feature (36): n=c or t
gattcagcgaagtcatgcggctgaataaacgtgaanggctgattattaaactttaataataagttttaata

SEQ ID NO: 45074 - DNA, 71 bp, chicken (Gallus Gallus)
  misc_feature (36): n=a or g
gaaagaaagaacaccaccacaacacaacctacactnaagaaccaacttcagtctgcgcacttaacacacca

SEQ ID NO: 45075 - DNA, 71 bp, chicken (Gallus Gallus)
  misc_feature (36): n=a or g
gcttctctgcctgttaaacaatgcgttcttcctacntttctaattaccagcaggaaaaataggaggaattt

SEQ ID NO: 45076 - DNA, 71 bp, chicken (Gallus Gallus)
  misc_feature (36): n=a or c
cactagagtggaaaacaagtgactgggtaagtaggnaaatttactgaaaaattgctgttatggaaatatca

SEQ ID NO: 45077 - DNA, 71 bp, chicken (Gallus Gallus)
  misc_feature (36): n=a or g
actgatatgtatgtgctacatcgagtcactattttntttctatgtatacaaagaatgaatgaacataggat

SEQ ID NO: 45078 - DNA, 71 bp, chicken (Gallus Gallus)
  misc_feature (36): n=g or t
ttgtagtgcttccctgagatggggagaagtgataancaaaacattttagaaaaaagacacttcctcagctt

SEQ ID NO: 45079 - DNA, 71 bp, chicken (Gallus Gallus)
  misc_feature (36): n=c or t
aggaagtgagatataacacctgcaaggtgctgtgangctcagcagtggttgtcagtgctgttagaaatgtg

SEQ ID NO: 45080 - DNA, 71 bp, chicken (Gallus Gallus)
  misc_feature (36): n=a or g
cattatgcgggagcaatgcctcctcccaattagggnatccaaaggctgaggacctcctcaccccatcaaac

SEQ ID NO: 45081 - DNA, 71 bp, chicken (Gallus Gallus)
  misc_feature (36): n=a or g
ctcagactaaaatgtaacactcgcgttaaaagagcncgctttgatgttgctgggcatctggggttcagctc

SEQ ID NO: 45082 - DNA, 71 bp, chicken (Gallus Gallus)
  misc_feature (36): n=a or g
gctacagaccttagccaggaagatttgtacagattntgcatcactgcagctggtatctgcagggcaaatag

SEQ ID NO: 45083 - DNA, 71 bp, chicken (Gallus Gallus)
  misc_feature (36): n=a or g
cgctgtatttatagcattggtttgtaaaatggcacngaataataacaagaaataatggctggtatctatat

SEQ ID NO: 45084 - DNA, 71 bp, chicken (Gallus Gallus)
  misc_feature (36): n=c or t
cagtgcttgtgctgcacatctccatccacacacagncaggaagatatgcacccggcaaagtattgcagtac

SEQ ID NO: 45085 - DNA, 71 bp, chicken (Gallus Gallus)
  misc_feature (36): n=a or g
ctctgcagtgatttatgatcacctggaggaaaaatnaaattaccagtgcgtctttcaatgtgatggaagca

SEQ ID NO: 45086 - DNA, 71 bp, chicken (Gallus Gallus)
  misc_feature (36): n=a or g
aggttctttttctgttaaacttcctaaatccaaccntactttacaagccctgtactccttgaagcacccac

SEQ ID NO: 45087 - DNA, 71 bp, chicken (Gallus Gallus)
  misc_feature (36): n=a or g
tttgatggcattacttcacaagtgattcaggtgagnagttttttgaggacgacggaagggtttgatgaaat

SEQ ID NO: 45088 - DNA, 71 bp, chicken (Gallus Gallus)
  misc_feature (36): n=a or g
gaagacaagcctgaagtgaaataaatctctcttctntatcaaagcgattcacaatccatttgataaatctt

SEQ ID NO: 45089 - DNA, 71 bp, chicken (Gallus Gallus)
  misc_feature (36): n=c or t
gtcttgcaagcagggccttaattggtcatttaacanaaaatttgcagtgattctcttattaaaatgcacag

SEQ ID NO: 45090 - DNA, 71 bp, chicken (Gallus Gallus)
  misc_feature (36): n=a or g
gcatgcttttagtgctcatttgatgctgcaaaatcnataggaatatgtccaagtgagacacaggagcagcc

SEQ ID NO: 45091 - DNA, 71 bp, chicken (Gallus Gallus)
  misc_feature (36): n=a or g
gtgctcccatcgcagctcctcccagcaggatcccgntccaacccccgacttcaacagcagacaaagatgga

SEQ ID NO: 45092 - DNA, 71 bp, chicken (Gallus Gallus)
  misc_feature (36): n=a or c
ccagtgtgtgtctgtaatgggaaaatacagaacaanaggacaggcaaccccaagccctcgctcaagtccct

SEQ ID NO: 45093 - DNA, 71 bp, chicken (Gallus Gallus)
  misc_feature (36): n=a or g
tgttggttaacctcatgttttatgcagaaacaaacncagagctattgtgaacaaatggttgggctcctggc

SEQ ID NO: 45094 - DNA, 71 bp, chicken (Gallus Gallus)
  misc_feature (36): n=a or g
gctgactacctgtgacacctcagccttgaaaatacntgagggacaaaacaatgaaaagatggccttgcatt

SEQ ID NO: 45095 - DNA, 71 bp, chicken (Gallus Gallus)
  misc_feature (36): n=a or g
ctagtttctataaaatagagataggaccaatctagntcaacttaattcattcaacatcagacaaagtcagg

SEQ ID NO: 45096 - DNA, 71 bp, chicken (Gallus Gallus)
  misc_feature (36): n=c or t
atttttagtgctatttcaatgtgcattaaacactcnggtgtttcagacaactttgaaatcaactaggacaa

SEQ ID NO: 45097 - DNA, 71 bp, chicken (Gallus Gallus)
  misc_feature (36): n=a or g
taattcctgaaaaaaatgtagcatcacacagcagantacagtgcaaacagaaagcagatgcaggacaactt

SEQ ID NO: 45098 - DNA, 71 bp, chicken (Gallus Gallus)
  misc_feature (36): n=a or g
gtataaagatgaggtgttaagatggtaaaaataganctttggttacaagccaaactctctaccgtataaat

SEQ ID NO: 45099 - DNA, 71 bp, chicken (Gallus Gallus)
  misc_feature (36): n=c or t
agacaattcatttctgaaatgctcagtgctttaaancatatataatctatgcttgttactctttttttcca

SEQ ID NO: 45100 - DNA, 71 bp, chicken (Gallus Gallus)
  misc_feature (36): n=c or t
ggagtttaagtgctgaaaaccacactgttttttagngtattaataagcatatctcaggaaccgacagttag

SEQ ID NO: 45101 - DNA, 71 bp, chicken (Gallus Gallus)
  misc_feature (36): n=a or c
acagccttaagcagacatgcatgactagtgccaganagttctctagtcttatgatacattcgttttaataa

SEQ ID NO: 45102 - DNA, 71 bp, chicken (Gallus Gallus)
  misc_feature (36): n=a or g
ggcaactccaaataatcccgaagctggcttattaanaaacgtttatcaagtagtaattcttgtcaatgttt

SEQ ID NO: 45103 - DNA, 71 bp, chicken (Gallus Gallus)
  misc_feature (36): n=a or g
atcacgacacagcagcaggattctcagaatatgctngctaatctattagtccataaatctgatttttatcg

SEQ ID NO: 45104 - DNA, 71 bp, chicken (Gallus Gallus)
  misc_feature (36): n=a or g
tctacctacacacagaggaactctgtgagacactancattcagagacaggagtaacaaaccaaggtattat

SEQ ID NO: 45105 - DNA, 71 bp, chicken (Gallus Gallus)
  misc_feature (36): n=c or t
caagttgaagcttctagcctggaaaatgggaatgcnggtgattgtttgaaatcaggacaaatacacctggg

SEQ ID NO: 45106 - DNA, 71 bp, chicken (Gallus Gallus)
  misc_feature (36): n=a or g
acataaactaacgaggtctgtgtactgtaacaaaanatcagcctctttttttgccttctgttgaccaacaa

SEQ ID NO: 45107 - DNA, 71 bp, chicken (Gallus Gallus)
  misc_feature (36): n=g or t
gagccaacagaattttagacccctggacaatatacnggcacctttcatcagtgttaaactgaaagcttacc

SEQ ID NO: 45108 - DNA, 71 bp, chicken (Gallus Gallus)
  misc_feature (36): n=c or t
cctgtccacaagacaaaatccaccagcatcttccanagccaagtgcaaggaaagagttgaagttcaattat

SEQ ID NO: 45109 - DNA, 71 bp, chicken (Gallus Gallus)
  misc_feature (36): n=a or c
aagatgagcatcctagacatgtttacagaggcaccnaattttgtaaggattaagtactatacctcacagca

SEQ ID NO: 45110 - DNA, 71 bp, chicken (Gallus Gallus)
  misc_feature (36): n=a or g
attaagtgagagctagagggcatattgcattcttcncaaactcaattccttcttctcttgataaatgttat

SEQ ID NO: 45111 - DNA, 71 bp, chicken (Gallus Gallus)
  misc_feature (36): n=c or t
catttaaaattctttcctgtcaacataacattgttntatttaatttactgtccagaaaacaaactgaaagt

SEQ ID NO: 45112 - DNA, 71 bp, chicken (Gallus Gallus)
  misc_feature (36): n=a or g
gcagcacatctattccaggtcaagaataggccaacntgttcccaagtactgcgtgtcctcagctttaaaat

SEQ ID NO: 45113 - DNA, 71 bp, chicken (Gallus Gallus)
  misc_feature (36): n=c or t
ttaacagagaagctttcccagtcaccccattaatcnctattagtacttgcagacatgatgaggtcacgtga

SEQ ID NO: 45114 - DNA, 71 bp, chicken (Gallus Gallus)
  misc_feature (36): n=a or g
agctctgacctgttactttggaaacccaagacagcnttgcctcaaacagcaatgcgcagagaaaacagact

SEQ ID NO: 45115 - DNA, 71 bp, chicken (Gallus Gallus)
  misc_feature (36): n=a or c
gcagagtgtaaaatagacattaccatttctcatatntttgttctcacctgaaacgatagtaactgggccgc

SEQ ID NO: 45116 - DNA, 71 bp, chicken (Gallus Gallus)
  misc_feature (36): n=c or t
agcaagccacagtggcctcctgcagggaaaatcacngcatccagcttgggcacctgctcatacatctccag

SEQ ID NO: 45117 - DNA, 71 bp, chicken (Gallus Gallus)
  misc_feature (36): n=c or t
cgctccttcacagatcccgtgtactggaggaactcnttctttaggtagatgtcaactccgtacagcttgga

SEQ ID NO: 45118 - DNA, 71 bp, chicken (Gallus Gallus)
  misc_feature (36): n=c or t
accatgattcgaatcagagttctgtcttttgttccngctccctgaaataaacaaaacaacaatgccatgta

SEQ ID NO: 45119 - DNA, 71 bp, chicken (Gallus Gallus)
  misc_feature (36): n=c or t
aaatattatttcattcctaatggtaaaacagcctcngtgatactttttagtgaaacaactatttattatct

SEQ ID NO: 45120 - DNA, 71 bp, chicken (Gallus Gallus)
  misc_feature (36): n=a or g
gtcttgatattaacagaacaaatttgcttcagaaanttaacttggaagttctatgactctcacattaagag

SEQ ID NO: 45121 - DNA, 71 bp, chicken (Gallus Gallus)
  misc_feature (36): n=c or t
tgccattcaggtttgtccatccagtttaatatctcngtgtctggaaaaatgaggaggtaagcagaaaggag

SEQ ID NO: 45122 - DNA, 71 bp, chicken (Gallus Gallus)
  misc_feature (36): n=a or c
gcctggacttctgggaaggacattagttctatatgnagtactggtgagatcattcctgggctggagaatct

SEQ ID NO: 45123 - DNA, 71 bp, chicken (Gallus Gallus)
  misc_feature (36): n=a or c
tatgtttaaaggttaaagggcactagaaatgttatnaattctgttttttgcagtgagataatgcattattt

SEQ ID NO: 45124 - DNA, 71 bp, chicken (Gallus Gallus)
  misc_feature (36): n=a or g
cttagaaaagagatggtcacaattgtgtatgctgcnttcagactggagcttttattgtaacatgctgggca

SEQ ID NO: 45125 - DNA, 71 bp, chicken (Gallus Gallus)
  misc_feature (36): n=c or t
gaagtcatgtccgccacctgcgtggcattctgtganttgcttttggaggtgctctaattctgtgtacctgg

SEQ ID NO: 45126 - DNA, 71 bp, chicken (Gallus Gallus)
  misc_feature (36): n=a or c
atttgagaaagttattccagcagtggtgtttaatangaggacatgatgctgagatctttccaagacattct

SEQ ID NO: 45127 - DNA, 71 bp, chicken (Gallus Gallus)
  misc_feature (36): n=a or c
ttatagccaaagcccacaaagaaatcagcattaaanctcagaggtatgaagctggtttacttcaagtaatg

SEQ ID NO: 45128 - DNA, 71 bp, chicken (Gallus Gallus)
  misc_feature (36): n=a or c
actatgagtgatggtggccatttctcctagccaacnacttttgaatgaattacagtgtagttcacaacaca

SEQ ID NO: 45129 - DNA, 71 bp, chicken (Gallus Gallus)
  misc_feature (36): n=c or t
tcaactgaagctctcattttggctgttggagggctntggactcctgttacagcttccctttcctactgtga

SEQ ID NO: 45130 - DNA, 71 bp, chicken (Gallus Gallus)
  misc_feature (36): n=a or g
cctttctagattgtccccgaagttctcagggcacantcgtcctgacaaacattttcttgaacaaacaacac

SEQ ID NO: 45131 - DNA, 71 bp, chicken (Gallus Gallus)
  misc_feature (36): n=a or g
ggttcaagtagaattgttttgtccttagagacatancgtttttcttgttagcactcaaacataatgttgtt

SEQ ID NO: 45132 - DNA, 71 bp, chicken (Gallus Gallus)
  misc_feature (36): n=c or t
tatataagcatctaaattaaggagaaaaggacatanttgctcataataaatcttaacctttacaataaaat

SEQ ID NO: 45133 - DNA, 71 bp, chicken (Gallus Gallus)
  misc_feature (36): n=a or c
agcttccctttaggttggcaacctaaaacttctccnaaggcagcacaacgtttacttgaaggaaaagagaa

SEQ ID NO: 45134 - DNA, 71 bp, chicken (Gallus Gallus)
  misc_feature (36): n=c or t
taggtggtatttactacttggttctcagtgatgcangctctgctggtcagtgtgccatagaaacaacagct

SEQ ID NO: 45135 - DNA, 71 bp, chicken (Gallus Gallus)
  misc_feature (36): n=c or t
caggacaagagctgggggacccagtagaactctccntctgagcatttgcttttactattaagccttatcac

SEQ ID NO: 45136 - DNA, 71 bp, chicken (Gallus Gallus)
  misc_feature (36): n=g or t
agtcaccaagttgcacctgaatccagaacaaaattnctaggtgaacttgccccatcttgagacatagcagt

SEQ ID NO: 45137 - DNA, 71 bp, chicken (Gallus Gallus)
  misc_feature (36): n=c or t
atgtataaacacagctctggagtagcagtgtgctcnatttttaatgttagccttgttaacttttttctagc

SEQ ID NO: 45138 - DNA, 71 bp, chicken (Gallus Gallus)
  misc_feature (36): n=c or t
gattatctcaaaggatcccagggattgttttgtttngtctttaatacctggggaaaaacgactctatatcc

SEQ ID NO: 45139 - DNA, 71 bp, chicken (Gallus Gallus)
  misc_feature (36): n=c or t
aggaattactaacaacctatacttactctgaacagngccccataaaccttaaaatgaaaaggtattctaat

SEQ ID NO: 45140 - DNA, 71 bp, chicken (Gallus Gallus)
  misc_feature (36): n=a or g
gactagttcccacctctcattcgtataatggttaantcttccaggtgaagaacccattctctttcccatag

SEQ ID NO: 45141 - DNA, 71 bp, chicken (Gallus Gallus)
  misc_feature (36): n=c or t
acctgtcttaaatctgcagctgtctggagaagtttnccctgaagggaatgctgagggtgtactgagatatc

SEQ ID NO: 45142 - DNA, 71 bp, chicken (Gallus Gallus)
  misc_feature (36): n=a or g
tgtactgagtttctgttgtggacattttattgagcnatgtgtaggtatgtaaagatacatagacacaaatg

SEQ ID NO: 45143 - DNA, 71 bp, chicken (Gallus Gallus)
  misc_feature (36): n=c or t
tttctttaaaccatgtgactgcactttgttgatacngcacaaacacaggatctagtgctagaaatggcttc

SEQ ID NO: 45144 - DNA, 71 bp, chicken (Gallus Gallus)
  misc_feature (36): n=c or t
gctcaggcacaaaatgacccagcagcacattctggntctgctgataggtggaacttcttataagtaccaaa

SEQ ID NO: 45145 - DNA, 71 bp, chicken (Gallus Gallus)
  misc_feature (36): n=c or t
tgggtcttccagtagtctccaaaggaatgtaacagngaagtcatctggggatgctcttctcaggcaaaagc

SEQ ID NO: 45146 - DNA, 71 bp, chicken (Gallus Gallus)
  misc_feature (36): n=c or t
agcatgctggcaaatttcagctttaaatcagaagcngatctgccttcatattaaaaaaaccctgcaactta

SEQ ID NO: 45147 - DNA, 71 bp, chicken (Gallus Gallus)
  misc_feature (36): n=c or t
tttctgttttgtgatttatatgctggaggtaaaganaagtggtcaggatatcagttttggatattctttca

SEQ ID NO: 45148 - DNA, 71 bp, chicken (Gallus Gallus)
  misc_feature (36): n=g or t
atttctccattatcatgttatttggattgattagtnatcatggtatttggattcactcatgaaaccaaaga

SEQ ID NO: 45149 - DNA, 71 bp, chicken (Gallus Gallus)
  misc_feature (36): n=a or g
cagaggttccaaggccttcatgtttcagttttagcncacacattaatccttgctccttttcgttttttaaa

SEQ ID NO: 45150 - DNA, 71 bp, chicken (Gallus Gallus)
  misc_feature (36): n=g or t
ttcttgaaactacactcaaaactgtatcagcataanggctccaaaagctatgaaagcaatgacaaaataaa

SEQ ID NO: 45151 - DNA, 71 bp, chicken (Gallus Gallus)
  misc_feature (36): n=a or g
aattctgatctcagaggtatttgttcagcatcatcnttacagaacctgatgctgtgtttgtattttacaaa

SEQ ID NO: 45152 - DNA, 71 bp, chicken (Gallus Gallus)
  misc_feature (36): n=c or t
taatcaaaatgtaatgctccagatgggtgacatcantgatttgactacatcaaaaaatatatatttaaaca

SEQ ID NO: 45153 - DNA, 71 bp, chicken (Gallus Gallus)
  misc_feature (36): n=c or t
gggaagctgatttcagccctaaattcaactgtgatnattcacataaggacagaagtgcctaggaaagctaa

SEQ ID NO: 45154 - DNA, 71 bp, chicken (Gallus Gallus)
  misc_feature (36): n=c or t
cttggaaaacctcaatattgctcctggatgagaacntcaccacaataatgcagatacttaccacccaacat

SEQ ID NO: 45155 - DNA, 71 bp, chicken (Gallus Gallus)
  misc_feature (36): n=c or t
caactagtccaatcctttctgatcctcacatgtggntgaagatctgctaggtcacagcaataagctgtttg

SEQ ID NO: 45156 - DNA, 71 bp, chicken (Gallus Gallus)
  misc_feature (36): n=a or g
gctccgaaatcaacacttgaccaacggatgggttcntacagcagatggaattggatgtgctatgtctgtct

SEQ ID NO: 45157 - DNA, 71 bp, chicken (Gallus Gallus)
  misc_feature (36): n=a or g
gtgtgtaggttacatacaggtttacttgttacatgncatcagaaccagatgcctttgcgatctttggaaca

SEQ ID NO: 45158 - DNA, 71 bp, chicken (Gallus Gallus)
  misc_feature (36): n=a or c
gaagcaacaaagaacatcaatagttactcctctagncatttatgaagatagcacatgtaaatatttgtata

SEQ ID NO: 45159 - DNA, 71 bp, chicken (Gallus Gallus)
  misc_feature (36): n=c or t
taatgattcaagactggtaacaatattctaagtaangagaagatctgagaaagagcagtaagaacaagctt

SEQ ID NO: 45160 - DNA, 71 bp, chicken (Gallus Gallus)
  misc_feature (36): n=c or t
ctttaggtgctaaaacagaaatttctcatagctttnggctacttctgttagcaatttctgagctcctctct

SEQ ID NO: 45161 - DNA, 71 bp, chicken (Gallus Gallus)
  misc_feature (36): n=a or g
aaggcttattggtgtaagctatgaaatcttgatacntgtgtacattacaacaacctccttaaaagggaagg

SEQ ID NO: 45162 - DNA, 71 bp, chicken (Gallus Gallus)
  misc_feature (36): n=a or g
cctggaactgctgcccttgaagctctctcactgcantccagctctgtatgcctgtgttgctttttgcttaa

SEQ ID NO: 45163 - DNA, 71 bp, chicken (Gallus Gallus)
  misc_feature (36): n=a or g
ctgatttgctgatcaaatagagacgattttgccttntaactctccttcgaagaatgagaatcaaggaaatg

SEQ ID NO: 45164 - DNA, 71 bp, chicken (Gallus Gallus)
  misc_feature (36): n=a or g
acaactcatcagttgcacagagacttttttcttcantttctctgcctgaacatgaattttcacttgtatcc

SEQ ID NO: 45165 - DNA, 71 bp, chicken (Gallus Gallus)
  misc_feature (36): n=c or t
atcagctccttttttggggctgagctcagtgcttantcacaggctgaaccacaaagctctccaatttcctt

SEQ ID NO: 45166 - DNA, 71 bp, chicken (Gallus Gallus)
  misc_feature (36): n=a or g
atctgtagtacacatgttgctatctcaagagccctntggtgaagttttctgcttcttgcaggaataggtat

SEQ ID NO: 45167 - DNA, 71 bp, chicken (Gallus Gallus)
  misc_feature (36): n=c or t
tcttgtggaatgaaatttgactgcttgatatttaanaaacagaggtctgcttatcttataaaaagtaggag

SEQ ID NO: 45168 - DNA, 71 bp, chicken (Gallus Gallus)
  misc_feature (36): n=c or t
gatcctttttatgtgtctcttgctgtgtcatctgangaatgccatgagttaaatatagtacattcatttaa

SEQ ID NO: 45169 - DNA, 71 bp, chicken (Gallus Gallus)
  misc_feature (36): n=g or t
gaagataattgaagtttttcataaatgaatccttcngtcacaaagcctagaacacaatatctctgtgttat

SEQ ID NO: 45170 - DNA, 71 bp, chicken (Gallus Gallus)
  misc_feature (36): n=c or t
aagtacattctgggaagtttcaaagtcataaacaangctttaaatgcctaggtctaggaaaagccacactt

SEQ ID NO: 45171 - DNA, 71 bp, chicken (Gallus Gallus)
  misc_feature (36): n=c or t
gatggtgtgctgccattgtctccaaagtgcttccangaaacagtcctgaaaatgagccaggagcataatgt

SEQ ID NO: 45172 - DNA, 71 bp, chicken (Gallus Gallus)
  misc_feature (36): n=c or t
atcttatatttttgttgcctggccgtgagttagaantgcaaagataaagcaaactgggattgcagttgtgg

SEQ ID NO: 45173 - DNA, 71 bp, chicken (Gallus Gallus)
  misc_feature (36): n=a or g
gggcaatgccgtgtatttttctgaggaaaggacacntcagtctcttcattccctgtgcacccttcagacag

SEQ ID NO: 45174 - DNA, 71 bp, chicken (Gallus Gallus)
  misc_feature (36): n=a or c
tcatgttcttcattaaattaagtgcttaaagtttcntgggcagctgtgagatgcaccagctctgtttgtgt

SEQ ID NO: 45175 - DNA, 71 bp, chicken (Gallus Gallus)
  misc_feature (36): n=a or g
acacactggttttcctggagatgtcgaagtcctccntgtcatgaagttaagcagacttagaataaagaaaa

SEQ ID NO: 45176 - DNA, 71 bp, chicken (Gallus Gallus)
  misc_feature (36): n=a or g
tgaaaatcgttcataatggagtcattgtcatggctncacgttaagtaacgtgggttttcatttgacttgct

SEQ ID NO: 45177 - DNA, 71 bp, chicken (Gallus Gallus)
  misc_feature (36): n=a or g
cctgaatgtccctatgactgcccatggagcagcacnttgtttctggtgcttgatggttctgaagactctct

SEQ ID NO: 45178 - DNA, 71 bp, chicken (Gallus Gallus)
  misc_feature (36): n=a or g
aaattcaacgtctttttatgagacttgaaggaacanggacctttgtgtaggtatacagaggccttttcttt

SEQ ID NO: 45179 - DNA, 71 bp, chicken (Gallus Gallus)
  misc_feature (36): n=c or t
gttgttctccctctgacactgaagattagctatacnaaagacttatctgacttgctgcaaaatccttacac

SEQ ID NO: 45180 - DNA, 71 bp, chicken (Gallus Gallus)
  misc_feature (36): n=a or g
tgttttcttttcacttgtgttgcaataaacacttcnaggctgaatatacctgcactttgaaaagtacaacc

SEQ ID NO: 45181 - DNA, 71 bp, chicken (Gallus Gallus)
  misc_feature (36): n=g or t
tatttctatttaattcttctttatgactcactctgngctgggttaaacaggagagcttggtatgttttttt

SEQ ID NO: 45182 - DNA, 71 bp, chicken (Gallus Gallus)
  misc_feature (36): n=a or g
attacccaagaatgcagctcagccactggtgcatcntatgcgccacactgtcgccaaatttgcagatgttc

SEQ ID NO: 45183 - DNA, 71 bp, chicken (Gallus Gallus)
  misc_feature (36): n=c or t
cctaaattttccagatcaaactgagtaaagcttctnctacatttggaatctttgagtccttggaagaatca

SEQ ID NO: 45184 - DNA, 71 bp, chicken (Gallus Gallus)
  misc_feature (36): n=g or t
agaagctacattcaaagtaacataaatcaagagtcngatgattacagttaatcagagcaagcagtagcaaa

SEQ ID NO: 45185 - DNA, 71 bp, chicken (Gallus Gallus)
  misc_feature (36): n=a or g
agtgtactgtgttattgtacccggaggaggtgatgnggacttatttatagagacagtgtctgtcaggggaa

SEQ ID NO: 45186 - DNA, 71 bp, chicken (Gallus Gallus)
  misc_feature (36): n=a or g
gcttaattattagcacggttttcttcaaagggaatngaaagtggaaatggttatttttatgccagtgtcaa

SEQ ID NO: 45187 - DNA, 71 bp, chicken (Gallus Gallus)
  misc_feature (36): n=c or t
acacccaggctaaataccacggccacggcctgcccngactccacaaagctttggatagcagcacacagata

SEQ ID NO: 45188 - DNA, 71 bp, chicken (Gallus Gallus)
  misc_feature (36): n=a or g
gacagaaaatttcccaccctctctcagacaaaactnaggagcacccctggatgccagctgacatttaaggc

SEQ ID NO: 45189 - DNA, 71 bp, chicken (Gallus Gallus)
  misc_feature (36): n=c or t
gcaaatgaaacataatttacctttctgcagcacggntccaactcaacctagaatttggcagaacaaaacaa

SEQ ID NO: 45190 - DNA, 71 bp, chicken (Gallus Gallus)
  misc_feature (36): n=g or t
ttcaaatgtgctgtgaccgtcccctctttgtagacnaactcactaatgttattaaagcttaccatcacttt

SEQ ID NO: 45191 - DNA, 71 bp, chicken (Gallus Gallus)
  misc_feature (36): n=a or g
aactcctggcacttggttgctgacacattggcatantatgtgctatttacaatggatgaaatcatactctg

SEQ ID NO: 45192 - DNA, 71 bp, chicken (Gallus Gallus)
  misc_feature (36): n=a or g
tgaaagagttagagaaatgaatactcttcctcaccnctgagcagaaactaaagtatcatgtcatccaccta

SEQ ID NO: 45193 - DNA, 71 bp, chicken (Gallus Gallus)
  misc_feature (36): n=c or t
gactcaaagaaacgatcatcattaccaccaatggcncttttgaaccccatagaaatatctacagctttcct

SEQ ID NO: 45194 - DNA, 71 bp, chicken (Gallus Gallus)
  misc_feature (36): n=a or g
tagaatagcagtgaccaattctggagttgttaaccntgggcaaatgggaaatgacgtcactgttgctcatt

SEQ ID NO: 45195 - DNA, 71 bp, chicken (Gallus Gallus)
  misc_feature (36): n=a or g
agtcacctcacctttctgttcatcaaatgtcctcanagttctccagtttacttgcaacctaggacatctgg

SEQ ID NO: 45196 - DNA, 71 bp, chicken (Gallus Gallus)
  misc_feature (36): n=a or g
aggatctggatttccttgggtactgattcaaccacntgatgttttttgagtgtattgctggttttattagt

SEQ ID NO: 45197 - DNA, 71 bp, chicken (Gallus Gallus)
  misc_feature (36): n=a or g
attgtagtaatacctagatcatgcagcaaaggaganacaagtcaactctggcaaggtgttgtgtgacttgt

SEQ ID NO: 45198 - DNA, 71 bp, chicken (Gallus Gallus)
  misc_feature (36): n=a or c
aacctttcagaacccttctaaaatgaacacagccanatactgtaaagtggatcatgggaagtatgaagtat

SEQ ID NO: 45199 - DNA, 71 bp, chicken (Gallus Gallus)
  misc_feature (36): n=a or g
ggttttgggattgccacaaatgaacttggtgtctancctggattatgaggggtaatctgaagtaactacct

SEQ ID NO: 45200 - DNA, 71 bp, chicken (Gallus Gallus)
  misc_feature (36): n=a or g
tgactctcttgtttgtctttgcctggaaataattanttggttacagctgctgattgtataagttattgttc

SEQ ID NO: 45201 - DNA, 71 bp, chicken (Gallus Gallus)
  misc_feature (36): n=g or t
tttagattgtcttttgcaatgtgtcccttcctaaanacctgttcagggcacatggaaatgtaaagctttta

SEQ ID NO: 45202 - DNA, 71 bp, chicken (Gallus Gallus)
  misc_feature (36): n=g or t
attccttaggtatccacaaatctttaaaagaaaatnacaggctgggcagactatttatgtcatagaccctg

SEQ ID NO: 45203 - DNA, 71 bp, chicken (Gallus Gallus)
  misc_feature (36): n=c or t
ggtttggaacatttaggtgttcgtgtgtaagcgacngatctaaagtttagtgcatctacagcagcagagca

SEQ ID NO: 45204 - DNA, 71 bp, chicken (Gallus Gallus)
  misc_feature (36): n=c or t
ggaacatctcaccctcaccaagaggtaatcaaaatngtgatggactcaagtcgttacctaaatcctcttat

SEQ ID NO: 45205 - DNA, 71 bp, chicken (Gallus Gallus)
  misc_feature (36): n=a or g
agcttcatggatatgctgtaaatcattccagaatcngcagtgtgaagaatttttgataaaattgtttagat

SEQ ID NO: 45206 - DNA, 71 bp, chicken (Gallus Gallus)
  misc_feature (36): n=a or g
tcgtgctgccgtggaaatccactcacacacagcctnaaaaaacatggcattgcaccaaaaggttaatcccg

SEQ ID NO: 45207 - DNA, 71 bp, chicken (Gallus Gallus)
  misc_feature (36): n=a or g
aaaaagaaaagcaaaactgataaatgttacataccngtagagttatatagtgtgcatccactgtgaataaa

SEQ ID NO: 45208 - DNA, 71 bp, chicken (Gallus Gallus)
  misc_feature (36): n=g or t
atcctgtctgtaagtacctgaggggtgctttcctgngggggcattttctgcctcccccttctggagtaaat

SEQ ID NO: 45209 - DNA, 71 bp, chicken (Gallus Gallus)
  misc_feature (36): n=a or g
attactgcacatgtgcctagtgcttccaaacccacntgttttgaagcattttaggttgtttaggcactata

SEQ ID NO: 45210 - DNA, 71 bp, chicken (Gallus Gallus)
  misc_feature (36): n=g or t
cttctgttctttatgttggccttggaagagttcctnttttccaaacaagacccaagccttgtccattagtg

SEQ ID NO: 45211 - DNA, 71 bp, chicken (Gallus Gallus)
  misc_feature (36): n=a or g
taaaaaggaaaccttgaagttggaatgtatctggcntatacttggttacagagtttgacatccatacactg

SEQ ID NO: 45212 - DNA, 71 bp, chicken (Gallus Gallus)
  misc_feature (36): n=a or g
agcaacaaaaaattattacagggactcaggggaagntagtccttgtttgaaggtaactgggttgtggctga

SEQ ID NO: 45213 - DNA, 71 bp, chicken (Gallus Gallus)
  misc_feature (36): n=c or t
gttttctacctccagtatttgtcaatttgcttttcnaaggcttgcagtgaagggctcctggatttgttgga

SEQ ID NO: 45214 - DNA, 71 bp, chicken (Gallus Gallus)
  misc_feature (36): n=c or t
caggataatataggactggaagaatggcaagttctnaaacgccccacttaaaactgacaaattttgactaa

SEQ ID NO: 45215 - DNA, 71 bp, chicken (Gallus Gallus)
  misc_feature (36): n=a or g
cagcagcactggaaaaatatagctgtagtagtgganaacaattaagtcctggtgaaaagcatatcctgagg

SEQ ID NO: 45216 - DNA, 71 bp, chicken (Gallus Gallus)
  misc_feature (36): n=a or g
gtacgtttgctatagactaattcttaaaaattaaanttgtacttctaagaactacagtgttttggtacctc

SEQ ID NO: 45217 - DNA, 71 bp, chicken (Gallus Gallus)
  misc_feature (36): n=a or g
ttcaaattatcttcagagtatgcagtcatactactnctgctttgtgaatattgtttgaagggccatactaa

SEQ ID NO: 45218 - DNA, 71 bp, chicken (Gallus Gallus)
  misc_feature (36): n=a or g
ctccctagttccctcactgaagctggcatagaagcncaggcaaagggaagcatctcccgtgattacccact

SEQ ID NO: 45219 - DNA, 71 bp, chicken (Gallus Gallus)
  misc_feature (36): n=c or t
gctatcaaatttccaatctgcttcactgctcaaaangaacgttttaatattagcaaatcagctgtttgctt

SEQ ID NO: 45220 - DNA, 71 bp, chicken (Gallus Gallus)
  misc_feature (36): n=a or g
tttctaaatacaaactgtgaaagagaaattgaatantggcaggcttgtaaatggaaatgcaactgcttcaa

SEQ ID NO: 45221 - DNA, 71 bp, chicken (Gallus Gallus)
  misc_feature (36): n=a or g
tcgcatggacctgaaatgcaaattgagtctggttcntactgcttaatatttgtcttgtgtagtccagtgct

SEQ ID NO: 45222 - DNA, 71 bp, chicken (Gallus Gallus)
  misc_feature (36): n=a or g
ttagtgggcaaactgcaagagcgccgtggctctccngcgaattgctggctgccaccgcttccccttccccc

SEQ ID NO: 45223 - DNA, 71 bp, chicken (Gallus Gallus)
  misc_feature (36): n=a or g
aagatagtttgaatagacagtgtctaataccaaacngcacttagcaaatagaagcgaaaccatcacactgt

SEQ ID NO: 45224 - DNA, 71 bp, chicken (Gallus Gallus)
  misc_feature (36): n=a or g
aaagaaaatcatcttgagcaggctttaaaagctagngggaagtcagacctagccaccacaggttcgtgaag

SEQ ID NO: 45225 - DNA, 71 bp, chicken (Gallus Gallus)
  misc_feature (36): n=a or g
atataggtcactgagaaatgcaaccagggacctcgnttatgcttcacaaacttgtttggctcatggttctt

SEQ ID NO: 45226 - DNA, 71 bp, chicken (Gallus Gallus)
  misc_feature (36): n=c or t
ttgtttgagtattgggaaggggatttcctgagaatntggtgactgcacatcaggagccgataccaacacac

SEQ ID NO: 45227 - DNA, 71 bp, chicken (Gallus Gallus)
  misc_feature (36): n=c or t
atggcctgaaaacttgattcatttttcccagctagnatcaatttgcctaataaaagatatctgggcttatt

SEQ ID NO: 45228 - DNA, 71 bp, chicken (Gallus Gallus)
  misc_feature (36): n=a or g
atgcatgtgcagaactttttaatatacacctaatcnaagagaacatacaaactccaagcatcttcaaaagc

SEQ ID NO: 45229 - DNA, 71 bp, chicken (Gallus Gallus)
  misc_feature (36): n=a or g
taaagaggagagaaatgaatctctgtagagcaatcntattctcattctgcggaacaggtttagttttaaat

SEQ ID NO: 45230 - DNA, 71 bp, chicken (Gallus Gallus)
  misc_feature (36): n=c or t
gatttttgctggccaccttcttagctatcatgtacnttggatcacttatagataattgcttttgtctgtac

SEQ ID NO: 45231 - DNA, 71 bp, chicken (Gallus Gallus)
  misc_feature (36): n=a or g
tgtaggctcctgatgagttcagagttcacagggccncatcacacctcccaagtgacccacggtttgggggt

SEQ ID NO: 45232 - DNA, 71 bp, chicken (Gallus Gallus)
  misc_feature (36): n=a or g
tctatctacatccttaacacctcccaagattctacngttaggctacctacgaattcctcagaatttctcct

SEQ ID NO: 45233 - DNA, 71 bp, chicken (Gallus Gallus)
  misc_feature (36): n=g or t
ccttcagctcagactgatcccatgatgaaaaccagncagttacaaaaaacatttctctccagggctccctt

SEQ ID NO: 45234 - DNA, 71 bp, chicken (Gallus Gallus)
  misc_feature (36): n=c or t
ttaaagaaaagctaaaaatatggagtgatagaatangtagttcacaagaaacacatcactcacaagatgta

SEQ ID NO: 45235 - DNA, 71 bp, chicken (Gallus Gallus)
  misc_feature (36): n=g or t
aatgattaattaggctaagcccaagctgctggcacngcacgggatcccaaacgcacttgtacgtactgaag

SEQ ID NO: 45236 - DNA, 71 bp, chicken (Gallus Gallus)
  misc_feature (36): n=a or c
ttatctcctctcagcttatgcatcccttctataaantggaatatttctgtttctgccaggcctgcagggag

SEQ ID NO: 45237 - DNA, 71 bp, chicken (Gallus Gallus)
  misc_feature (36): n=a or g
ctcatacaagataaggcccaatttttccatctcctntttgtcataaaagtagtaagtgttactgtgccagt

SEQ ID NO: 45238 - DNA, 71 bp, chicken (Gallus Gallus)
  misc_feature (36): n=g or t
tgttcacgtgattgttagctatttttctacctgganagctataagttttctacaagattagctgcctaaag

SEQ ID NO: 45239 - DNA, 71 bp, chicken (Gallus Gallus)
  misc_feature (36): n=a or g
acacttccacatctctatttttgtcatctcccctcnaagagagaaggaatcttctcatctcaatttggggg

SEQ ID NO: 45240 - DNA, 71 bp, chicken (Gallus Gallus)
  misc_feature (36): n=a or g
ttttacctctgcccatcacccaagggagtccctgcncacaaaaacttgcccagacaagcaactcatttggt

SEQ ID NO: 45241 - DNA, 71 bp, chicken (Gallus Gallus)
  misc_feature (36): n=c or t
gataataaatcacatctgtgaagccatccttcctgnttccatcacacatctggtcaagcactctcactagc

SEQ ID NO: 45242 - DNA, 71 bp, chicken (Gallus Gallus)
  misc_feature (36): n=a or g
tcaaattcccagtgacacaagcacattctctgtttngcctggacaatgaatatgatccacaaaacacagat

SEQ ID NO: 45243 - DNA, 71 bp, chicken (Gallus Gallus)
  misc_feature (36): n=a or g
gatttcagtgtcactattgtacttctaaatacattnttatcatacagtctcaaatgacagaaataattaag

SEQ ID NO: 45244 - DNA, 71 bp, chicken (Gallus Gallus)
  misc_feature (36): n=g or t
gtactaattgagaaatattcctgccctgccaatctnctgtctaaggtggatgcctccctggaagagcagat

SEQ ID NO: 45245 - DNA, 71 bp, chicken (Gallus Gallus)
  misc_feature (36): n=a or g
aaattcctgcagcttaccatgttacaaagcccctcntggactgtacagtctagtgttccaaatttaagctg

SEQ ID NO: 45246 - DNA, 71 bp, chicken (Gallus Gallus)
  misc_feature (36): n=c or t
ttggcacaaaagtacttgggatagtggataagcccnagttagcagttgcctatgtggttcacagtccacaa

SEQ ID NO: 45247 - DNA, 71 bp, chicken (Gallus Gallus)
  misc_feature (36): n=c or t
atgtgttctggaggcagatctaaagaattaatctanaggtgtaagtatttggtgtcctaacactgtgaaag

SEQ ID NO: 45248 - DNA, 71 bp, chicken (Gallus Gallus)
  misc_feature (36): n=g or t
tattaattaccttactttagaaaatccacttttcancatcagaataataggtcttgttaacctctcatttg

SEQ ID NO: 45249 - DNA, 71 bp, chicken (Gallus Gallus)
  misc_feature (36): n=c or t
cttcttagtcagtattaaattgtccaaacaaaatangaaatcgcagtttacaggaaagaaattgtttattc

SEQ ID NO: 45250 - DNA, 71 bp, chicken (Gallus Gallus)
  misc_feature (36): n=c or t
tgatttcactaaactaagggttaaaagaacattcantgcaaaatgatattatgtatgtatggcaaattcat

SEQ ID NO: 45251 - DNA, 71 bp, chicken (Gallus Gallus)
  misc_feature (36): n=c or t
cagaaatgctaaccccgtaactaggtctgatacatnagttgaaatgaagccaggaagtttgtccaaggcca

SEQ ID NO: 45252 - DNA, 71 bp, chicken (Gallus Gallus)
  misc_feature (36): n=c or t
ctggtagatgcctcatcttcctgtttgtcatcctcngaagtcagtttttcatcttcctccaggtgcgtgta

SEQ ID NO: 45253 - DNA, 71 bp, chicken (Gallus Gallus)
  misc_feature (36): n=a or c
actcttgtacatatgtcagaggtccttaacaagaanaagcaccaccatattattgggttatatttcctttc

SEQ ID NO: 45254 - DNA, 71 bp, chicken (Gallus Gallus)
  misc_feature (36): n=a or g
ttgtttctcctttttctccagctgaataagctatgnaaggccacttcctcctgtcataatttaaggaaaat

SEQ ID NO: 45255 - DNA, 71 bp, chicken (Gallus Gallus)
  misc_feature (36): n=a or c
agaacagccactgcagacactgcagtcctcctctcnagggaaaagtgcagctctgtgacctgtctcctcta

SEQ ID NO: 45256 - DNA, 71 bp, chicken (Gallus Gallus)
  misc_feature (36): n=a or g
ccgcagttcttgccaagcactcagtaagttactgcntttgtctgctctggagtcacacatctgggtacagg

SEQ ID NO: 45257 - DNA, 71 bp, chicken (Gallus Gallus)
  misc_feature (36): n=c or t
ctggggctgtaaggcacgtggctttgtctggccttnataagcacttgttttcagatgtctgatctttaatt

SEQ ID NO: 45258 - DNA, 71 bp, chicken (Gallus Gallus)
  misc_feature (36): n=g or t
agaagctgccatccaaaaatctgacaccagaaattncctgctcttcttcctagaactaaagccaaccgtac

SEQ ID NO: 45259 - DNA, 71 bp, chicken (Gallus Gallus)
  misc_feature (36): n=a or g
acaaacaaaagttttactttaatgtggtgttgatcntggcatcctgctctgtctttaaaagaaccctgttc

SEQ ID NO: 45260 - DNA, 71 bp, chicken (Gallus Gallus)
  misc_feature (36): n=c or t
atgaagagtagttgaggcttaagaggtggatttctnaaatgttgacatctgctttgttattgagagaagta

SEQ ID NO: 45261 - DNA, 71 bp, chicken (Gallus Gallus)
  misc_feature (36): n=c or t
ttgaattcacacaaaatctggactttaaaattctangtacaaagcattatgtttcctaggatatcatgcac

SEQ ID NO: 45262 - DNA, 71 bp, chicken (Gallus Gallus)
  misc_feature (36): n=c or t
aaattatataatactgccaattacatatacaaatcnagggagaattttaagacctttcgtaagaattttaa

SEQ ID NO: 45263 - DNA, 71 bp, chicken (Gallus Gallus)
  misc_feature (36): n=c or t
cattggtgcttaaattacaattacaggagtattcangcatagtgattattctatggtaaaatacaattacc

SEQ ID NO: 45264 - DNA, 71 bp, chicken (Gallus Gallus)
  misc_feature (36): n=a or g
aaagtgatttcttaaagaaatatcctcaaacttggnaattggtcatacaagaagttttgctgctctttctc

SEQ ID NO: 45265 - DNA, 71 bp, chicken (Gallus Gallus)
  misc_feature (36): n=a or g
gttgcagattcccaaaaatcaaagcttattgcagcntctcaaaaatcaaagatggttgtagcacaccatga

SEQ ID NO: 45266 - DNA, 71 bp, chicken (Gallus Gallus)
  misc_feature (36): n=a or c
tcagaaaaactcaggattataactccccttaaggancaagaagttaatgagggtcaagaaattatcttcaa

SEQ ID NO: 45267 - DNA, 71 bp, chicken (Gallus Gallus)
  misc_feature (36): n=a or g
aacacataataacaccagaagctgacctttctgacnttcctggaggtcaaatcactgtgcgaattgggcat

SEQ ID NO: 45268 - DNA, 71 bp, chicken (Gallus Gallus)
  misc_feature (36): n=a or g
tcctcagatatattatcactcacatcactgatatangattcatcatcagaagcctaaaagataaataaaat

SEQ ID NO: 45269 - DNA, 71 bp, chicken (Gallus Gallus)
  misc_feature (36): n=a or g
cacactttgtgctgtgactacaggtttaatagccangggtcaggccccaatttactaacctgcacaatgtt

SEQ ID NO: 45270 - DNA, 71 bp, chicken (Gallus Gallus)
  misc_feature (36): n=a or c
gagccaattgcaacaacagctctcattcttacttancatctctaaggtagaagtactggtactctctatac

SEQ ID NO: 45271 - DNA, 71 bp, chicken (Gallus Gallus)
  misc_feature (36): n=a or g
gctctctaattataaaaatggtattaggtgtttcancacttaacatttatcatacttttgtagtaggcgct

SEQ ID NO: 45272 - DNA, 71 bp, chicken (Gallus Gallus)
  misc_feature (36): n=a or g
cacaaccacactactgcgttttgcagagtaagctgnctgtgagattgcttaacctcaacaactctgtacgt

SEQ ID NO: 45273 - DNA, 71 bp, chicken (Gallus Gallus)
  misc_feature (36): n=a or g
gcggattaagtcagggcaaagggagtcatccagatnccagtaagaaactttgtggaaatattatttgaata

SEQ ID NO: 45274 - DNA, 71 bp, chicken (Gallus Gallus)
  misc_feature (36): n=a or c
ttattaaattacattctttttcctggaatctacttnttttctggatgcttccttgaatctaggatcttttg

SEQ ID NO: 45275 - DNA, 71 bp, chicken (Gallus Gallus)
  misc_feature (36): n=c or t
gagatggcatacgtttgtttagcagctgaattcagnccccacgacggtttgcacggaagtatgagctgtgc

SEQ ID NO: 45276 - DNA, 71 bp, chicken (Gallus Gallus)
  misc_feature (36): n=c or t
ttgttttaaaattcggttttgctacactgtaaatgnagtctctgcatttatatacaggtctctgtaaaaag

SEQ ID NO: 45277 - DNA, 71 bp, chicken (Gallus Gallus)
  misc_feature (36): n=c or t
atttcaacagtaattttgaagaagtttcagtacacngtgttgtgcagggctttataaaagatttttgtttc

SEQ ID NO: 45278 - DNA, 71 bp, chicken (Gallus Gallus)
  misc_feature (36): n=g or t
aatagtgaaataatgtaccaactgctgacagctggncttctgaattgtttatactgaattgtttgtctgtg

SEQ ID NO: 45279 - DNA, 71 bp, chicken (Gallus Gallus)
  misc_feature (36): n=c or t
gattttacaggacacagctagacttctgttttatgncttccatgccatccagggtttacacttgctagtgc

SEQ ID NO: 45280 - DNA, 71 bp, chicken (Gallus Gallus)
  misc_feature (36): n=a or c
aagcctctggaacgttttgtttgtgggtctctcatnacctaaaaacataggggagtactctgcatttctgt

SEQ ID NO: 45281 - DNA, 71 bp, chicken (Gallus Gallus)
  misc_feature (36): n=a or g
ttctgttgctgcagagaaacctttatttttaatttnagatttttagattactgtaatggaagaatgtgtac

SEQ ID NO: 45282 - DNA, 71 bp, chicken (Gallus Gallus)
  misc_feature (36): n=a or g
aaacatacggcatgcaaatagaaacaccaacaggcnaaggtatcaattttgctgagcattcaggagcatcc

SEQ ID NO: 45283 - DNA, 71 bp, chicken (Gallus Gallus)
  misc_feature (36): n=a or g
gggcatcccatgtagctctactcaacatttccatcnttggtctgagcagtgtgaatgtaaggaaactgtta

SEQ ID NO: 45284 - DNA, 71 bp, chicken (Gallus Gallus)
  misc_feature (36): n=c or t
tagggtgatgacaaccacaggtgctgatggcttgangataacaaggtaagatagcttggtagaacaaggta

SEQ ID NO: 45285 - DNA, 71 bp, chicken (Gallus Gallus)
  misc_feature (36): n=a or g
taggcagtcctgagcctgaaacttatgtttatttcngcttcctggacttggaacttatagctgatgtacta

SEQ ID NO: 45286 - DNA, 71 bp, chicken (Gallus Gallus)
  misc_feature (36): n=a or g
tatgtcatttcttcttatgattactgaagcaaaganggggaaacagaattttcttgatggtaataaaacat

SEQ ID NO: 45287 - DNA, 71 bp, chicken (Gallus Gallus)
  misc_feature (36): n=a or g
tttctttttgctgcctatactaccgattcagccccngacataaaggctactcttgctaagcttatcgaaat

SEQ ID NO: 45288 - DNA, 71 bp, chicken (Gallus Gallus)
  misc_feature (36): n=a or g
taaatatcttcatctggcctgaataatagttgcttngtgcttgcgtgcatatcagatgaaaattcacacat

SEQ ID NO: 45289 - DNA, 71 bp, chicken (Gallus Gallus)
  misc_feature (36): n=g or t
atccagagaagctccgaacacttctgaatttataantatggtcttaatttcctgtcccaccaggtgatgtg

SEQ ID NO: 45290 - DNA, 71 bp, chicken (Gallus Gallus)
  misc_feature (36): n=c or t
gggccgcgatttatgttcgggtccattttactgcgnctcttggaggagttgggtttccttcccgggccaac

SEQ ID NO: 45291 - DNA, 71 bp, chicken (Gallus Gallus)
  misc_feature (36): n=c or t
attttgtgcagtctatgtaaacccaatttcttctcnctgtgaattgcgtgggttaagtgggagtctgtgtt

SEQ ID NO: 45292 - DNA, 71 bp, chicken (Gallus Gallus)
  misc_feature (36): n=a or g
ggaagatgctgcagaagaacaagttaaaaagcaagncagagactgtgttgtaatgctaacaggcaattaac

SEQ ID NO: 45293 - DNA, 71 bp, chicken (Gallus Gallus)
  misc_feature (36): n=a or c
ggtgatgtctatgtctgtctggcccgagaccgctgngtgaggaatggcagaatgaattcctactgttgtgt

SEQ ID NO: 45294 - DNA, 71 bp, chicken (Gallus Gallus)
  misc_feature (36): n=a or c
ccagtataaattcagacagaagtccgagtcttggantttctaacatcatagttaggctccttcagcagaca

SEQ ID NO: 45295 - DNA, 71 bp, chicken (Gallus Gallus)
  misc_feature (36): n=g or t
atgagtgcaatatgcaggtaaatgtacaatacaaangcatgttgtagctatcatctgtagtcatgctcaca

SEQ ID NO: 45296 - DNA, 71 bp, chicken (Gallus Gallus)
  misc_feature (36): n=a or g
ggctaagaccccactactttaagctttgttgataantagtaataacttgagttgaattcagaacaaatgat

SEQ ID NO: 45297 - DNA, 71 bp, chicken (Gallus Gallus)
  misc_feature (36): n=c or t
ggcagaatgaattaatgaattagtgattatggaaanagagccctagaagtatgtccccagcaagtgaagac

SEQ ID NO: 45298 - DNA, 71 bp, chicken (Gallus Gallus)
  misc_feature (36): n=c or t
agacactgatgtgtaccttagaatgtctgcctccangtcaagctgacgctgttttgtgaagagaggatgta

SEQ ID NO: 45299 - DNA, 71 bp, chicken (Gallus Gallus)
  misc_feature (36): n=a or g
agaataatcaagctggagtaaaatctgttttgtganatgattaagaatatgcatcatttattcacgagtat

SEQ ID NO: 45300 - DNA, 71 bp, chicken (Gallus Gallus)
  misc_feature (36): n=a or c
tgaatctaaacatggagatcaagaattcattacaantgcttaattctgtgctcgtcgttctcaaaaggaaa

SEQ ID NO: 45301 - DNA, 71 bp, chicken (Gallus Gallus)
  misc_feature (36): n=a or c
gaaatatgacttatctctaacttatggttttgaatncgattaatgaacatgctgataagtgaaattaagca

SEQ ID NO: 45302 - DNA, 71 bp, chicken (Gallus Gallus)
  misc_feature (36): n=a or g
atttcgttctgcattttagccctaggaatatcagantagtagtcccagattccttggtcaccactgaaggg

SEQ ID NO: 45303 - DNA, 71 bp, chicken (Gallus Gallus)
  misc_feature (36): n=c or t
tgtgctctatctctgcagtcaatgctttcagttctntttctcattgtgggctatatgcttccaagtcaata

SEQ ID NO: 45304 - DNA, 71 bp, chicken (Gallus Gallus)
  misc_feature (36): n=c or t
ctaagaggcgatcgagctgaaaggctgccccgtggnattgggaacaggctgggggctggtcctgcttctta

SEQ ID NO: 45305 - DNA, 71 bp, chicken (Gallus Gallus)
  misc_feature (36): n=a or g
ctcgggactcattggacagaatggaaaataaaagtncagtagaagatcaggatcaatacagtgagaaaagg

SEQ ID NO: 45306 - DNA, 71 bp, chicken (Gallus Gallus)
  misc_feature (36): n=c or t
gctactctgtgagggcccaatgggtacacctgctangttctgaatgtacaattcacttaattggtgtgcag

SEQ ID NO: 45307 - DNA, 71 bp, chicken (Gallus Gallus)
  misc_feature (36): n=a or g
gtacaccatactcccattaatgtttacagaagtttngtgtgatcatcaaagtgagaatacgctcacatgtt

SEQ ID NO: 45308 - DNA, 71 bp, chicken (Gallus Gallus)
  misc_feature (36): n=a or c
gaaaacagttttttctggacttttctttaggtgacncaaggcttcagtaatccaagtaatgcaatctagat

SEQ ID NO: 45309 - DNA, 71 bp, chicken (Gallus Gallus)
  misc_feature (36): n=c or t
actagatgtagaagttgctcatggctattctctatntctggaagttcctatcaacaaggagatgtttcttg

SEQ ID NO: 45310 - DNA, 71 bp, chicken (Gallus Gallus)
  misc_feature (36): n=a or g
aatgacctggaagtaaacaataaaaaaactgcctcnttttgctcacacatggaaaaacattctcgcaacat

SEQ ID NO: 45311 - DNA, 71 bp, chicken (Gallus Gallus)
  misc_feature (36): n=g or t
aacattgcctgccagcaatattctgttacctgaggnttacgttcaatatcctatgcattttctaagtacta

SEQ ID NO: 45312 - DNA, 71 bp, chicken (Gallus Gallus)
  misc_feature (36): n=g or t
taaacttacacatacttttctggatgttgatctctnattgtacttatccacataaacatgaagtctataaa

SEQ ID NO: 45313 - DNA, 71 bp, chicken (Gallus Gallus)
  misc_feature (36): n=a or c
gttgatgtggttcagtgtgatgtctcctctttaccngacagcatgtcagagacttttgacacagttatcat

SEQ ID NO: 45314 - DNA, 71 bp, chicken (Gallus Gallus)
  misc_feature (36): n=a or g
aacatcacccttcttcagaaacatcactgggcacangtcattcccaccatcacctatataagcaatctgcg

SEQ ID NO: 45315 - DNA, 71 bp, chicken (Gallus Gallus)
  misc_feature (36): n=c or t
tcttaatgaagagaaaatggacctaataattgtgtnatatccagtgctatctgtgttttctgctaaactag

SEQ ID NO: 45316 - DNA, 71 bp, chicken (Gallus Gallus)
  misc_feature (36): n=a or g
tattaactgaaagcaaatagtttaacgtagaatacnctggttttaagtattcttaaaagagtttgcatgtg

SEQ ID NO: 45317 - DNA, 71 bp, chicken (Gallus Gallus)
  misc_feature (36): n=a or g
atgtgcacagtattccatttgggaaaaaaaggaacntgggatgtggaggaatgtttctgactagtatgcag

SEQ ID NO: 45318 - DNA, 71 bp, chicken (Gallus Gallus)
  misc_feature (36): n=c or t
cagtctgttccaaagtcttaagaggtctctctccangatacctgaattagcttctgtgttgaagaaactgt

SEQ ID NO: 45319 - DNA, 71 bp, chicken (Gallus Gallus)
  misc_feature (36): n=c or t
tgctgttttcgtttcatctgccatcatttcttcttntcatgttcattccaggcatcagtagttggtttatg

SEQ ID NO: 45320 - DNA, 71 bp, chicken (Gallus Gallus)
  misc_feature (36): n=c or t
aagggacagctctggctatagatgcccactgcttgntctctctagtgtttgaagggagactgttcagtgcc

SEQ ID NO: 45321 - DNA, 71 bp, chicken (Gallus Gallus)
  misc_feature (36): n=a or g
aacacagaaacaagaaggtcagtagagatgtacctnatgaggaacctgcccctgtgccttgcatcacaaaa

SEQ ID NO: 45322 - DNA, 71 bp, chicken (Gallus Gallus)
  misc_feature (36): n=a or g
cataaaggcaacattaggtttctttgtaatgtgtantggacgaagactgcagacaaaaagagaatggcctt

SEQ ID NO: 45323 - DNA, 71 bp, chicken (Gallus Gallus)
  misc_feature (36): n=a or g
actacgactgctggcacaatgaatatgcaagaagcnagaggcaaaactttgccactgagctagagttattc

SEQ ID NO: 45324 - DNA, 71 bp, chicken (Gallus Gallus)
  misc_feature (36): n=a or g
gcataatgatcttattaaacaaatgaagctccccanaataaagttgtagctagctatcattaaaggaaatg

SEQ ID NO: 45325 - DNA, 71 bp, chicken (Gallus Gallus)
  misc_feature (36): n=c or t
tgttgtgagttttcatgtgtcactatttagttagcnttgcaatttctgtagaacttcgtgttctgcgttat

SEQ ID NO: 45326 - DNA, 71 bp, chicken (Gallus Gallus)
  misc_feature (36): n=a or g
cacagcaacaacaaaaccactctccgtactttcagnaatgagctactgggcactaatatcactaaaggctc

SEQ ID NO: 45327 - DNA, 71 bp, chicken (Gallus Gallus)
  misc_feature (36): n=a or g
agcttgttactgcttagcaatgcttaaggccagacnatgatagtactataggttttgcttgatgtttcttg

SEQ ID NO: 45328 - DNA, 71 bp, chicken (Gallus Gallus)
  misc_feature (36): n=c or t
taaaatgagatacctacgtaagcacacaaaatctcnaggtacagctcaattaattgaagctaggagaatta

SEQ ID NO: 45329 - DNA, 71 bp, chicken (Gallus Gallus)
  misc_feature (36): n=a or g
ccttggaataccctttgcatttctcaatgatggaangagggttgatattgtcagtgggtgtgccatgtcag

SEQ ID NO: 45330 - DNA, 71 bp, chicken (Gallus Gallus)
  misc_feature (36): n=a or g
cagaagagtttaagaccaactaatcctcagctaganagaaaaccaaattctcaatagattagctaggtacc

SEQ ID NO: 45331 - DNA, 71 bp, chicken (Gallus Gallus)
  misc_feature (36): n=a or c
aacagttactctgcaaagtgcaagtctacagcagancacattttgcaccccatcaaaactggtccatcctt

SEQ ID NO: 45332 - DNA, 71 bp, chicken (Gallus Gallus)
  misc_feature (36): n=c or t
tcttacatcgtggactgttaaacagcttttgtgtcngttcacagatgcaaatccctaggtccagaacaaaa

SEQ ID NO: 45333 - DNA, 71 bp, chicken (Gallus Gallus)
  misc_feature (36): n=a or c
acatcagtatacactttaaagtgttgtcactttgcngtattttaaagtaaaagccgctaaagaggacatcc

SEQ ID NO: 45334 - DNA, 71 bp, chicken (Gallus Gallus)
  misc_feature (36): n=c or t
attaactcccattcttgtaccctcccctcaggttanacattcaaaggcttggtttacaaatagatgattca

SEQ ID NO: 45335 - DNA, 71 bp, chicken (Gallus Gallus)
  misc_feature (36): n=a or g
tgcctcatgcactgttagtaagaaacttctaaagtnaatgtaaatacatttcccaacttctgcagagagtc

SEQ ID NO: 45336 - DNA, 71 bp, chicken (Gallus Gallus)
  misc_feature (36): n=a or g
actatgaatatcagtagatggatccaagagcagagnaaaaaaattataaacaccctcaaaaactcgacatt

SEQ ID NO: 45337 - DNA, 71 bp, chicken (Gallus Gallus)
  misc_feature (36): n=c or t
ggcaaagccagttggtttgcaaaacttacattgtgngcatttcaaatattctcctaactctctgacaacta

SEQ ID NO: 45338 - DNA, 71 bp, chicken (Gallus Gallus)
  misc_feature (36): n=c or t
aaatgttaacttttcctttgtttaccaggagattantcctcaaagagagtaatcattaattattagataca

SEQ ID NO: 45339 - DNA, 71 bp, chicken (Gallus Gallus)
  misc_feature (36): n=a or g
ctctcgaaggttccagtgtgcttaaatccttgtaanatcatttaaagtgctgaaaaattgccaacttcgga

SEQ ID NO: 45340 - DNA, 71 bp, chicken (Gallus Gallus)
  misc_feature (36): n=a or g
caccagatagaggaggatgaacttgaggcagagaantttaaagcaataaggacgatctacgatcatctgca

SEQ ID NO: 45341 - DNA, 71 bp, chicken (Gallus Gallus)
  misc_feature (36): n=g or t
ctgcatacacctccacaccacatacattactctcantttgtacagttctctaccagcagcagtcctacaga

SEQ ID NO: 45342 - DNA, 71 bp, chicken (Gallus Gallus)
  misc_feature (36): n=a or g
aagcctgtgaagacatttagatggctcatttactcncaaggaaacatcaatgtatggatggagcagaatga

SEQ ID NO: 45343 - DNA, 71 bp, chicken (Gallus Gallus)
  misc_feature (36): n=c or t
tgtattgcattccatacagtattaatgtgcagcctngcagaaagtgttagcaatggaagttctgatcactt

SEQ ID NO: 45344 - DNA, 71 bp, chicken (Gallus Gallus)
  misc_feature (36): n=a or g
aaatgttgatgaaaataaaatcttctgggcatgagntgaaagagagatctgtggtttaatcatagggaaat

SEQ ID NO: 45345 - DNA, 71 bp, chicken (Gallus Gallus)
  misc_feature (36): n=a or g
tctgaagagcctttactcacccttctaatggtctgngtatcatctggaaataaagtttctgcagttggacc

SEQ ID NO: 45346 - DNA, 71 bp, chicken (Gallus Gallus)
  misc_feature (36): n=c or t
ttccactctgcggatcctaaaaaatggtcagtagtngaagtgttggtctctgaaattcaggcacccagtga

SEQ ID NO: 45347 - DNA, 71 bp, chicken (Gallus Gallus)
  misc_feature (36): n=a or g
attgttaaagagaggtaaggaatatataaaacttcngattgtgtggtttcatcatagcctggttgtaacaa

SEQ ID NO: 45348 - DNA, 71 bp, chicken (Gallus Gallus)
  misc_feature (36): n=c or t
ctacccatggtatgggaagtgggaggcatttgcttngcagtgagaagcagctcaccttccctcctctctgg

SEQ ID NO: 45349 - DNA, 71 bp, chicken (Gallus Gallus)
  misc_feature (36): n=g or t
cttcacctctctggttcccttccagcaatgcatatntagggatggaggaggaaggtaggctgcaaaggctg

SEQ ID NO: 45350 - DNA, 71 bp, chicken (Gallus Gallus)
  misc_feature (36): n=c or t
gagtctgtgtatgactgtaagttcaggtgacagcantgcaaacttcctttccttcatacggctacagtttg

SEQ ID NO: 45351 - DNA, 71 bp, chicken (Gallus Gallus)
  misc_feature (36): n=c or t
tctgtacgtgggtcagaaggaattacagtcaaggtnttatacaggaatgacaaattcaagtgcaatgagtt

SEQ ID NO: 45352 - DNA, 71 bp, chicken (Gallus Gallus)
  misc_feature (36): n=g or t
aagagccgggggggcacagagggattctcttcctgnagcctggtgggggagacatggttgtggtaggaact

SEQ ID NO: 45353 - DNA, 71 bp, chicken (Gallus Gallus)
  misc_feature (36): n=c or t
ttttttggctgaggtcacagagtcacccaacaaacngactgcagatgaaattcttgaggctggagaacatg

SEQ ID NO: 45354 - DNA, 71 bp, chicken (Gallus Gallus)
  misc_feature (36): n=a or c
gcatctagttgaggttgaccctgtcttctgcgcctntgaagttttaggctgtgactctaagagaaaacaaa

SEQ ID NO: 45355 - DNA, 71 bp, chicken (Gallus Gallus)
  misc_feature (36): n=a or c
tagtgatcaatcaagcaattagatctctcatctctncagtttctagaaaaactcagagaaatttcaggtgg

SEQ ID NO: 45356 - DNA, 71 bp, chicken (Gallus Gallus)
  misc_feature (36): n=c or t
aatacagagtgcaaaaggtgtttccatatataagancccaaacatcttcttcactgcaattattaatacac

SEQ ID NO: 45357 - DNA, 71 bp, chicken (Gallus Gallus)
  misc_feature (36): n=c or t
ccaagcatttccattacagtagacctcctcctgccncatctctgtcccaggttttaaagactgctagtgag

SEQ ID NO: 45358 - DNA, 71 bp, chicken (Gallus Gallus)
  misc_feature (36): n=a or g
tttcccatggctctttccaagataataattgctccncagatgtttccctcaggacagtgagatgttcaggt

SEQ ID NO: 45359 - DNA, 71 bp, chicken (Gallus Gallus)
  misc_feature (36): n=c or t
cccggagcgtgtgtggaattgattgcattttgctgntggatatgttagctaaaatgcaaattagctgtcac

SEQ ID NO: 45360 - DNA, 71 bp, chicken (Gallus Gallus)
  misc_feature (36): n=c or t
agtaatacacaagctttctttgaactctgctagatnccaacatgctcagcaaagagcttaatggacagaca

SEQ ID NO: 45361 - DNA, 71 bp, chicken (Gallus Gallus)
  misc_feature (36): n=c or t
aagtgtcctaaagcccacttgccatcccccagatancagttctgatgcatacagatgggtaacaggacata

SEQ ID NO: 45362 - DNA, 71 bp, chicken (Gallus Gallus)
  misc_feature (36): n=a or g
atgttatctacaaatagctaatgcacattaatacanatcgttttatacattacaagtattgacatgctcca

SEQ ID NO: 45363 - DNA, 71 bp, chicken (Gallus Gallus)
  misc_feature (36): n=a or g
aacttggtcacaaccttcttggcttgttccagtgangactcctccccaggagcagaactgctcatcgtgat

SEQ ID NO: 45364 - DNA, 71 bp, chicken (Gallus Gallus)
  misc_feature (36): n=a or c
agcatagatggcagagtggggaggctatgacctctnatactcttgaagtccagttgctaaaagaatacagg

SEQ ID NO: 45365 - DNA, 71 bp, chicken (Gallus Gallus)
  misc_feature (36): n=c or t
tgtgctgttctcaccacccatcctcatgtctgctgncagtagcctggtttcactcaactcccagctttcta

SEQ ID NO: 45366 - DNA, 71 bp, chicken (Gallus Gallus)
  misc_feature (36): n=c or t
gaaacatgtctgcttagttttggtgtgcagaatttnaaaagactaaaggaagtgatcaaagcagttcctgg

SEQ ID NO: 45367 - DNA, 71 bp, chicken (Gallus Gallus)
  misc_feature (36): n=g or t
agagttgtagctttgaaggagtgagtttaaaaaacngaaaacatggcaattgatggccaaaaaaagactgc

SEQ ID NO: 45368 - DNA, 71 bp, chicken (Gallus Gallus)
  misc_feature (36): n=c or t
tttcttaaaatccaaaatggcgttgatagcctgttnctacatctatatacgtatgcagataaatagataaa

SEQ ID NO: 45369 - DNA, 71 bp, chicken (Gallus Gallus)
  misc_feature (36): n=c or t
ggagcagaaggaaaatttgggaagttattcaatctngtgattacaaaggttaccatttcttcctattctca

SEQ ID NO: 45370 - DNA, 71 bp, chicken (Gallus Gallus)
  misc_feature (36): n=a or g
aagtgactcttaaagagaatatcctagctttctcangccctgggactgtagcatataacagaggcaaaaac

SEQ ID NO: 45371 - DNA, 71 bp, chicken (Gallus Gallus)
  misc_feature (36): n=c or t
gcaaaaagtgttcttgctcatccatttccttacacnttatgcataacacatacctgtcaagttaaaaaaaa

SEQ ID NO: 45372 - DNA, 71 bp, chicken (Gallus Gallus)
  misc_feature (36): n=c or t
aagagatctataaacttcttgttttggtagccagangagatgtttgtgcttcccacctgatcaacagagct

SEQ ID NO: 45373 - DNA, 71 bp, chicken (Gallus Gallus)
  misc_feature (36): n=c or t
aacagatctccaaaattaaggaagatcaggctatangcttacctttgatgctggcagaaatcagaagtaac

SEQ ID NO: 45374 - DNA, 71 bp, chicken (Gallus Gallus)
  misc_feature (36): n=c or t
gatttcaaacatggtaaaagcgcttaagtttaaagntttccttcactatattgacagttttctttggcaaa

SEQ ID NO: 45375 - DNA, 71 bp, chicken (Gallus Gallus)
  misc_feature (36): n=g or t
acacaggctaactccagtccccctgctggtggatgnttgttttcttcttgctatgcattcactagaaaaac

SEQ ID NO: 45376 - DNA, 71 bp, chicken (Gallus Gallus)
  misc_feature (36): n=a or g
gagacaaaccctaatgggcatagtaaaatacagcancaatgtaacatcttaggaagagatacagtagaata

SEQ ID NO: 45377 - DNA, 71 bp, chicken (Gallus Gallus)
  misc_feature (36): n=c or t
gaaatcagtactcgtgtgttgcagttcacttgggangtagtggcatgaaaacacatacgttatgcagctag

SEQ ID NO: 45378 - DNA, 71 bp, chicken (Gallus Gallus)
  misc_feature (36): n=g or t
gcagtttatgtttctagaggtctgattagaagtcantattagattaacatctgaaacatcgttgttcctag

SEQ ID NO: 45379 - DNA, 71 bp, chicken (Gallus Gallus)
  misc_feature (36): n=c or t
taaccttattgccaggctggaattagcctttgagtngctttctgctcttccgtggctagcaacaccacaga

SEQ ID NO: 45380 - DNA, 71 bp, chicken (Gallus Gallus)
  misc_feature (36): n=a or g
ctgggagaagagaaagtgcccgaggctgaaggagancagttacaaagggcataacgggaacagacacacca

SEQ ID NO: 45381 - DNA, 71 bp, chicken (Gallus Gallus)
  misc_feature (36): n=c or t
aaatgtaacataaaatctagtggcatatggttgcanttaggtgactaatactcgcttggggccaccttcat

SEQ ID NO: 45382 - DNA, 71 bp, chicken (Gallus Gallus)
  misc_feature (36): n=c or t
acgcccagatcaaaccgtgatggggatttgagctcngtcaggctcacggcagcccctgaaattccacttct

SEQ ID NO: 45383 - DNA, 71 bp, chicken (Gallus Gallus)
  misc_feature (36): n=c or t
catcaatcagcatctggttagcatgtttatggcatnggtcatgctgaagcacttaacaggtcagaatgtat

SEQ ID NO: 45384 - DNA, 71 bp, chicken (Gallus Gallus)
  misc_feature (36): n=c or t
agcaatgtctaggtaaactggttgaggaagtcgatncagccaaaaacccatgcagtacaatttcaggtggt

SEQ ID NO: 45385 - DNA, 71 bp, chicken (Gallus Gallus)
  misc_feature (36): n=c or t
tttccctttgctagggcttttatctgtattaatcanggatcatcctccatttccctgagatcttaatatat

SEQ ID NO: 45386 - DNA, 71 bp, chicken (Gallus Gallus)
  misc_feature (36): n=c or t
ggtttgacctctgaaaggtaccttgttttgaggganctcgcagggtttcatcctgagggtgccgctcgagt

SEQ ID NO: 45387 - DNA, 71 bp, chicken (Gallus Gallus)
  misc_feature (36): n=c or t
taaaggatcttgcttcagatcttcatttgggaattnggttatgcagccaaaatgaaaaggaaatatatgtt

SEQ ID NO: 45388 - DNA, 71 bp, chicken (Gallus Gallus)
  misc_feature (36): n=a or g
tccattaacgtcaaagagcagatctggagtaaatanaagaagtgtgaatttgtctttcctatgtctgcaca

SEQ ID NO: 45389 - DNA, 71 bp, chicken (Gallus Gallus)
  misc_feature (36): n=c or t
aaacaaaaccacagaaagacggtggtatctcaattnaactgcagttcagtgttgcctcagaaggagctgca

SEQ ID NO: 45390 - DNA, 71 bp, chicken (Gallus Gallus)
  misc_feature (36): n=a or g
cacagctgcagtactatatgtaacagattaaaacanaaacttggttaattacaaatgggactctaggtaat

SEQ ID NO: 45391 - DNA, 71 bp, chicken (Gallus Gallus)
  misc_feature (36): n=a or g
ctgtggcctgggaatgagaacacttctcttgaactntagatgcagtgagaaatttcaggtgattattgtgt

SEQ ID NO: 45392 - DNA, 71 bp, chicken (Gallus Gallus)
  misc_feature (36): n=c or t
ccatcatcacttgctgtcagcgacgttctcagatgngggaccttaaactaggctggcagagcaggtagcaa

SEQ ID NO: 45393 - DNA, 71 bp, chicken (Gallus Gallus)
  misc_feature (36): n=a or g
tctgtgttatattgaattgctgttcctgtatctcanacgtggtctaagaacttggctgaaatatcacagcc

SEQ ID NO: 45394 - DNA, 71 bp, chicken (Gallus Gallus)
  misc_feature (36): n=g or t
atggagctgggttggtgcaagtccgtgtgcgctggnaatgccctcctccacaggttgctgagcactgagac

SEQ ID NO: 45395 - DNA, 71 bp, chicken (Gallus Gallus)
  misc_feature (36): n=a or g
tgtgaaatgcccgttaatttaatacaaacattaacncagcacaccaaggatacactccaaagaaatgggaa

SEQ ID NO: 45396 - DNA, 71 bp, chicken (Gallus Gallus)
  misc_feature (36): n=c or t
tttccctcaaaactgcagccctcttcttccccagcnctgtgaaaactgataaaagttttggcccaattacg

SEQ ID NO: 45397 - DNA, 71 bp, chicken (Gallus Gallus)
  misc_feature (36): n=a or c
ttatagcagcttttaaacaagacattaacctgatanagcaaagcatctaaaatgacactccctattttaga

SEQ ID NO: 45398 - DNA, 71 bp, chicken (Gallus Gallus)
  misc_feature (36): n=c or t
tcagggaccacagccctggtttactggtcaaaccangctaagctctttaggtaagctttattattgcagat

SEQ ID NO: 45399 - DNA, 71 bp, chicken (Gallus Gallus)
  misc_feature (36): n=g or t
atgcaagggaatctgcagctgttgttcttgtgctcnctgacagtggtagaagagctacaagctgtctcacg

SEQ ID NO: 45400 - DNA, 71 bp, chicken (Gallus Gallus)
  misc_feature (36): n=c or t
ttagtaatgagaagattgctgctgctgatggatgantgcaatgaagagcacaacttaaaccaactatttgt

SEQ ID NO: 45401 - DNA, 71 bp, chicken (Gallus Gallus)
  misc_feature (36): n=c or t
ggcagcatcattaagacagcagcagtatgagttatncagttttgctgctttaatacatttccatgcagatt

SEQ ID NO: 45402 - DNA, 71 bp, chicken (Gallus Gallus)
  misc_feature (36): n=c or t
ccttgccatgcccacgtcctaggcgatcaaagctgnatcttttgctgctttgcctatccaaatggaaatca

SEQ ID NO: 45403 - DNA, 71 bp, chicken (Gallus Gallus)
  misc_feature (36): n=c or t
ttgaaaactagaccactgaatacagttcttgagttngtgtctgacttatcatgtgatctcctcaggtcgaa

SEQ ID NO: 45404 - DNA, 71 bp, chicken (Gallus Gallus)
  misc_feature (36): n=c or t
gcagcctatacaatttcttcaactgacattacaggncatgcctgcatcgttcataatgaacagggaatgta

SEQ ID NO: 45405 - DNA, 71 bp, chicken (Gallus Gallus)
  misc_feature (36): n=a or g
atttttcattagtttctatggcttttgtgtcaaaanttatcgagtcaacgagtgtacgtgaaggatgttgt

SEQ ID NO: 45406 - DNA, 71 bp, chicken (Gallus Gallus)
  misc_feature (36): n=c or t
agggtgatgccactctaaggatgaaattagattcanggtagagccaacagtgcttattcagtttctggctc

SEQ ID NO: 45407 - DNA, 71 bp, chicken (Gallus Gallus)
  misc_feature (36): n=a or g
tgagatgtgagcaggttctctagaacaaaattgtcntgtgatgaattagacttttcagattctcattgggt

SEQ ID NO: 45408 - DNA, 71 bp, chicken (Gallus Gallus)
  misc_feature (36): n=c or t
gtatgaaaggaagaaatccagtgtgaacccagagangcactggaagaagaacacctggacttgcaagtcat

SEQ ID NO: 45409 - DNA, 71 bp, chicken (Gallus Gallus)
  misc_feature (36): n=a or g
ctttagaaatctccaccacagattttctctaatgantaacagaccaaactcaacctttcctttcacctgtc

SEQ ID NO: 45410 - DNA, 71 bp, chicken (Gallus Gallus)
  misc_feature (36): n=a or g
cgccatttgctatgccttttcttccactccacagtnagacagcagcataagctcactgcagattctgcaga

SEQ ID NO: 45411 - DNA, 71 bp, chicken (Gallus Gallus)
  misc_feature (36): n=a or g
tccaagccaattcttcttctttccacaaagtctggntccatattatctgctgatagtttatgccaaacaaa

SEQ ID NO: 45412 - DNA, 71 bp, chicken (Gallus Gallus)
  misc_feature (36): n=c or t
aacctggaagatctggagtctttcaagcagatggangtctactccatggcccttgttctgtgggagatggc

SEQ ID NO: 45413 - DNA, 71 bp, chicken (Gallus Gallus)
  misc_feature (36): n=a or g
ctgaactacagaccatgaaagatatgcacattaaanaagagaccagcactgaattcaatgcaccaacattg

SEQ ID NO: 45414 - DNA, 71 bp, chicken (Gallus Gallus)
  misc_feature (36): n=a or g
cctgcactagataaaccatttatctggaaaactacntcacatcagctgctagcttctgccattctgcttct

SEQ ID NO: 45415 - DNA, 71 bp, chicken (Gallus Gallus)
  misc_feature (36): n=c or t
gtgctcctcgtggggaggggacacatgcagcatccngcctcctctttttgctcacagctgccagatcatgt

SEQ ID NO: 45416 - DNA, 71 bp, chicken (Gallus Gallus)
  misc_feature (36): n=a or g
gattgcatattttatttccctcttgtgaagacaatngtaaccagaatagcttaaaaaagggaagtggcact

SEQ ID NO: 45417 - DNA, 71 bp, chicken (Gallus Gallus)
  misc_feature (36): n=a or g
tggggaagaaaagattgccattgaagaactaagaanagcactggattaattctctgcctgcagccaaactg

SEQ ID NO: 45418 - DNA, 71 bp, chicken (Gallus Gallus)
  misc_feature (36): n=c or t
atgtttggcagctctacacacacagaggagttttgntgctctgttgcacctcacatcccaaatctggtccc

SEQ ID NO: 45419 - DNA, 71 bp, chicken (Gallus Gallus)
  misc_feature (36): n=c or t
agttgctgcattaccaaatggtttcaatacctcacncccgtagattccatcctataagagatactccaaag

SEQ ID NO: 45420 - DNA, 71 bp, chicken (Gallus Gallus)
  misc_feature (36): n=c or t
ggcatcaattctttgagaagttttgaatgctcaaantgatgtaaatatcctcaatctttgtgagtttttca

SEQ ID NO: 45421 - DNA, 71 bp, chicken (Gallus Gallus)
  misc_feature (36): n=c or t
cccatgtgaaatgtgccaaaggaataggtgtcaccncattgttagcagcctaaggagggtggctctaatgt

SEQ ID NO: 45422 - DNA, 71 bp, chicken (Gallus Gallus)
  misc_feature (36): n=a or g
cttctgcctactacatttaaaccacagaggaagggngatttaatatctacgaagagctggtttacaatcaa

SEQ ID NO: 45423 - DNA, 71 bp, chicken (Gallus Gallus)
  misc_feature (36): n=a or g
ctaggtttctagaatgtactggaatacaaatcaccntactatctataacttttctgttaaatgggagatgt

SEQ ID NO: 45424 - DNA, 71 bp, chicken (Gallus Gallus)
  misc_feature (36): n=g or t
agattctcatttttgcaaaaacctccaactagttgntggtctggagggaatttctccagagcaaagcagta

SEQ ID NO: 45425 - DNA, 71 bp, chicken (Gallus Gallus)
  misc_feature (36): n=g or t
gggtttccatattgctggcatgctaccaaaatctgnttagaaaaaggaaaatgacaagctgtggtaattat

SEQ ID NO: 45426 - DNA, 71 bp, chicken (Gallus Gallus)
  misc_feature (36): n=g or t
taaaccggggaataaccatgttgggcaccagggagncatttatggtcaggaatgccagtctttcaccatct

SEQ ID NO: 45427 - DNA, 71 bp, chicken (Gallus Gallus)
  misc_feature (36): n=c or t
caggatcaaagctgagagtatcacagtccataagcnttgtttccttagtcttgactgcctgtggaacattt

SEQ ID NO: 45428 - DNA, 71 bp, chicken (Gallus Gallus)
  misc_feature (36): n=c or t
tcacgtggtctggtctagcataaggtcttcacatangcaattcagtcagaaagtaatgatcagttatctga

SEQ ID NO: 45429 - DNA, 71 bp, chicken (Gallus Gallus)
  misc_feature (36): n=g or t
attatagttgagtttacatttggaaaacaagagatnaggacttccctcatactgaggtgctaagtgaactg

SEQ ID NO: 45430 - DNA, 71 bp, chicken (Gallus Gallus)
  misc_feature (36): n=a or g
ggaaagtggaataattacccagaactaatgcccacncatggaatgtatcagcatagatctagtggtataat

SEQ ID NO: 45431 - DNA, 71 bp, chicken (Gallus Gallus)
  misc_feature (36): n=c or t
gatctgaccagcgcatccagctggaacacagcctgngattcaggattagggaaattttatttccttctcca

SEQ ID NO: 45432 - DNA, 71 bp, chicken (Gallus Gallus)
  misc_feature (36): n=c or t
ctcttcgaagcctgcagttatgcaactgtgctgcangtcgccacccttagttttgagagatatgtggctat

SEQ ID NO: 45433 - DNA, 71 bp, chicken (Gallus Gallus)
  misc_feature (36): n=a or g
aaattggactccaagagtctcttccactacagacantttgacaaaggagatgctgcatagaagatctgtgt

SEQ ID NO: 45434 - DNA, 71 bp, chicken (Gallus Gallus)
  misc_feature (36): n=c or t
acaagatacagatgtgaaagaagttctatctcttgngggaaaggcaaaagctacctgaaatcatgagtcca

SEQ ID NO: 45435 - DNA, 71 bp, chicken (Gallus Gallus)
  misc_feature (36): n=g or t
cttagaagtacaaacagtttcattatgatatggtcntagctgtaacattttaggagcacattaaaaaagac

SEQ ID NO: 45436 - DNA, 71 bp, chicken (Gallus Gallus)
  misc_feature (36): n=c or t
aatgtttgattctgttgctccaaatcaaaaactctngttttcagctttatacattcctccctcagatccta

SEQ ID NO: 45437 - DNA, 71 bp, chicken (Gallus Gallus)
  misc_feature (36): n=a or c
cagagacattttacagcggtgactctctctctctgntgctttctaattaaagcacagatagatgattccat

SEQ ID NO: 45438 - DNA, 71 bp, chicken (Gallus Gallus)
  misc_feature (36): n=c or t
actaaatgcagtgtgtgtgaggaagcttatcttccntgggaattctgcagctgagtgtcctattctgagct

SEQ ID NO: 45439 - DNA, 71 bp, chicken (Gallus Gallus)
  misc_feature (36): n=c or t
catatggtccatttaactcttcttttgactctccangcaatgtaataagataatttgcttcttttaatgcg

SEQ ID NO: 45440 - DNA, 71 bp, chicken (Gallus Gallus)
  misc_feature (36): n=c or t
caaagtatgttaatttaatgctatactaatcagtgncatgtcaaagcaatagttcaaatttaaatgtactt

SEQ ID NO: 45441 - DNA, 71 bp, chicken (Gallus Gallus)
  misc_feature (36): n=c or t
tgtgctgaagtcaaacctttcggagtgttgtaagangcagagccaagaaagggatatccaagactgaggct

SEQ ID NO: 45442 - DNA, 71 bp, chicken (Gallus Gallus)
  misc_feature (36): n=a or g
ccagaacacatataacctgctcaaactgaaccaganaaaaactcacaaactgtaaagatggtcatggttaa

SEQ ID NO: 45443 - DNA, 71 bp, chicken (Gallus Gallus)
  misc_feature (36): n=a or g
taaaatgaaagaacttatctaacctttctggatganctgaggacttaaatgagtgcatactatttttctag

SEQ ID NO: 45444 - DNA, 71 bp, chicken (Gallus Gallus)
  misc_feature (36): n=a or c
ctgtttggagcttaaaatatagtagcctgcagctgnagtgggaacttacagggattcagcaacccttttat

SEQ ID NO: 45445 - DNA, 71 bp, chicken (Gallus Gallus)
  misc_feature (36): n=c or t
aatgctattccactaaccactactcaagcaatgaanatttgctcatgatttgctgcttgcattcacatcag

SEQ ID NO: 45446 - DNA, 71 bp, chicken (Gallus Gallus)
  misc_feature (36): n=a or g
gcactactgctgtagatgatttcacatttaaagcanttaattagatgccttttggcaagttatttatacag

SEQ ID NO: 45447 - DNA, 71 bp, chicken (Gallus Gallus)
  misc_feature (36): n=a or g
ctacagagaaggtacagagaccttctagagatcagncaacaggaagtcaaaggagatgaagatcataacat

SEQ ID NO: 45448 - DNA, 71 bp, chicken (Gallus Gallus)
  misc_feature (36): n=g or t
tatccaacttattttgactgaattgtctaggcagtnctcattcaagttaattccatgggcagatgtgagga

SEQ ID NO: 45449 - DNA, 71 bp, chicken (Gallus Gallus)
  misc_feature (36): n=c or t
tgtgacattaaataacctgtgcatttgaatgtatancaacaattcatttaggaagcatgttctaggaagta

SEQ ID NO: 45450 - DNA, 71 bp, chicken (Gallus Gallus)
  misc_feature (36): n=a or g
ccaaagaccattcaagggaactgctttttaatctcngataaattttccaaacaagagaacagaaaattatt

SEQ ID NO: 45451 - DNA, 71 bp, chicken (Gallus Gallus)
  misc_feature (36): n=a or c
aggtgaggcatacccaaaacttcacagacaaaaagnaaattcttgattttgttcaaatatagattgatact

SEQ ID NO: 45452 - DNA, 71 bp, chicken (Gallus Gallus)
  misc_feature (36): n=a or g
ctctattaccattaaaacttgacatacattctgctnatgtgtgccaggaccagctggtacacacatatttc

SEQ ID NO: 45453 - DNA, 71 bp, chicken (Gallus Gallus)
  misc_feature (36): n=g or t
agatgactgaacagaatgctttctgtgaatcacaantctaaactggacaagaaatatcagagagaacgtga

SEQ ID NO: 45454 - DNA, 71 bp, chicken (Gallus Gallus)
  misc_feature (36): n=a or g
atgttgggttcatacagtcccttgaaattgctgcantgggtttaatgctccctaatgcaactactgcagga

SEQ ID NO: 45455 - DNA, 71 bp, chicken (Gallus Gallus)
  misc_feature (36): n=a or c
aaacattactttcaaaaaatcaaggacaataggaanaatacaaagattctggaagtgtctgttccttgcaa

SEQ ID NO: 45456 - DNA, 71 bp, chicken (Gallus Gallus)
  misc_feature (36): n=g or t
aagctccagacctggctgtgagggaaatgcatcggngtgtgaaggagcttggatttccaggagttcaaata

SEQ ID NO: 45457 - DNA, 71 bp, chicken (Gallus Gallus)
  misc_feature (36): n=c or t
gacaatatggctctagcatttcccagaaattacctnggatgaggcagggaacaatggatactgttatttct

SEQ ID NO: 45458 - DNA, 71 bp, chicken (Gallus Gallus)
  misc_feature (36): n=c or t
taaataatgaaatgaaaatcacgtcactttaggcangcatctcctgcacggtggaaataaatctactttag

SEQ ID NO: 45459 - DNA, 71 bp, chicken (Gallus Gallus)
  misc_feature (36): n=c or t
ctgtgatcctaaatctgcttccctccaaccttctcnggggtttcaccaatggtgctgcattttaaaagttt

SEQ ID NO: 45460 - DNA, 71 bp, chicken (Gallus Gallus)
  misc_feature (36): n=a or g
acttacagtgttttttcatgcgactcgagaactgcncaggactgcccttctcttctggatgtggatgctgg

SEQ ID NO: 45461 - DNA, 71 bp, chicken (Gallus Gallus)
  misc_feature (36): n=a or c
gattatggaaagaaattactggagttagagttagcncccagtgcttctgtagtgctgctgccggtaggtgt

SEQ ID NO: 45462 - DNA, 71 bp, chicken (Gallus Gallus)
  misc_feature (36): n=c or t
cgcaatgaaagtataatgtttttggaagtaccaagngtcaagaaaagaagcaactgacacaagctgaagtt

SEQ ID NO: 45463 - DNA, 71 bp, chicken (Gallus Gallus)
  misc_feature (36): n=g or t
acagttacaagtccacttagcttttacaaagtcctntcttctcatggaaaacgctattgcaagtaataaag

SEQ ID NO: 45464 - DNA, 71 bp, chicken (Gallus Gallus)
  misc_feature (36): n=a or c
agactctgactctgtagaaacagaagaatgtccccnacgtttgctttttgaaagaatcttgaggcttgatc

SEQ ID NO: 45465 - DNA, 71 bp, chicken (Gallus Gallus)
  misc_feature (36): n=g or t
aatgtatctcagaggaactttattatttctgtattntttgtggtatgagcatgaactttgacttcctgcct

SEQ ID NO: 45466 - DNA, 71 bp, chicken (Gallus Gallus)
  misc_feature (36): n=a or g
ttgctcactgccctcagggcactgtaaaacaaaccnggtagcttttgtagatgtttccactggttaagtcc

SEQ ID NO: 45467 - DNA, 71 bp, chicken (Gallus Gallus)
  misc_feature (36): n=c or t
tcagaatcactggattttcactgggatatgcaaaantgtcttcagattgctgttaccacccatcagagagc

SEQ ID NO: 45468 - DNA, 71 bp, chicken (Gallus Gallus)
  misc_feature (36): n=a or g
tcggtgcaagttaagaagcaattcattggcagaacngtaatttcatatccttgctttcaatccccaggatc

SEQ ID NO: 45469 - DNA, 71 bp, chicken (Gallus Gallus)
  misc_feature (36): n=g or t
gaaaaacgctgttactggttgcagtgctcacttggntattgttacatagtgctgcttcacgtggtgtacct

SEQ ID NO: 45470 - DNA, 71 bp, chicken (Gallus Gallus)
  misc_feature (36): n=c or t
ataaatagatggcgactgtaagtacttctcttctgnacattggttacccagagtgaaggtcagcaacttca

SEQ ID NO: 45471 - DNA, 71 bp, chicken (Gallus Gallus)
  misc_feature (36): n=c or t
ggccatctggaatatagatttgtatgtgtaaatcantctcttggcagcacagtaatagtatcttcgctgct

SEQ ID NO: 45472 - DNA, 71 bp, chicken (Gallus Gallus)
  misc_feature (36): n=a or g
aatagggcgactcggtctatttttcaggctctatcntatcatcagaaacatgcaaagacgggaagtgctgg

SEQ ID NO: 45473 - DNA, 71 bp, chicken (Gallus Gallus)
  misc_feature (36): n=a or c
gcatgtttcccatgtcctcagcttgattaaatgaangcttttccggcagagattctttattattcggagca

SEQ ID NO: 45474 - DNA, 71 bp, chicken (Gallus Gallus)
  misc_feature (36): n=a or g
acctataggaaggggggaaaatcagattaattatcncttgctttagtaaaaatggctgtgtaatggtgcag

SEQ ID NO: 45475 - DNA, 71 bp, chicken (Gallus Gallus)
  misc_feature (36): n=c or t
taaaacagaaaatgtcacatcttgctctgtatacangggcttagacaaaatgaagagcgaagaggttatta

SEQ ID NO: 45476 - DNA, 71 bp, chicken (Gallus Gallus)
  misc_feature (36): n=a or g
gcagtcatttctttacaatggaaataaaagtagttnatacaggagtgaggtgtttcgtctgttcagagcga

SEQ ID NO: 45477 - DNA, 71 bp, chicken (Gallus Gallus)
  misc_feature (36): n=a or c
accctggaattccactacacctcctattagcattcnatttctgatgtgacaatgaagtacattcatcccaa

SEQ ID NO: 45478 - DNA, 71 bp, chicken (Gallus Gallus)
  misc_feature (36): n=a or g
taccaaaaaccaagactgctggcacacggctgaggngacgctggtgacaagcagtaggacgagccaccttg

SEQ ID NO: 45479 - DNA, 71 bp, chicken (Gallus Gallus)
  misc_feature (36): n=g or t
acttttgagtttacgcagtcaaattgatagtatcantagtctggttaacaagcgttagtttatttactgaa

SEQ ID NO: 45480 - DNA, 71 bp, chicken (Gallus Gallus)
  misc_feature (36): n=c or t
tgaaaagctggcggtgggaacctgcgtgtgaacccntcttcacataaaaacacagctggctaaagctgcat

SEQ ID NO: 45481 - DNA, 71 bp, chicken (Gallus Gallus)
  misc_feature (36): n=a or c
tgccccaaagctggtttaggcttgtgtggtttccangtaaatacatgcttaagtaagcatttttagtattg

SEQ ID NO: 45482 - DNA, 71 bp, chicken (Gallus Gallus)
  misc_feature (36): n=c or t
ctcatacataaatgagaacacagatgagctaaatanggaccttatttaattccccatcacacaatcacaca

SEQ ID NO: 45483 - DNA, 71 bp, chicken (Gallus Gallus)
  misc_feature (36): n=a or g
tcttagtagtagataatccctgaaatatattcctancgcgggaagacagtgtctgtcttggacagtttatt

SEQ ID NO: 45484 - DNA, 71 bp, chicken (Gallus Gallus)
  misc_feature (36): n=c or t
cctgcatggctttgtattgtctcaggtaagggaagntgtgcttcaaacatctgagccaaatctaaaaatac

SEQ ID NO: 45485 - DNA, 71 bp, chicken (Gallus Gallus)
  misc_feature (36): n=c or t
taacgatgcacgattacagcaaattactaattgttntagtccaaaaggtaaaccgagggatgattctgtcc

SEQ ID NO: 45486 - DNA, 71 bp, chicken (Gallus Gallus)
  misc_feature (36): n=a or g
gcaagttatagacatatattctttagctgacgtggngaggacttggttttatgctttggtggtctgtagta

SEQ ID NO: 45487 - DNA, 71 bp, chicken (Gallus Gallus)
  misc_feature (36): n=c or t
ttttaaagtaataattaagttaattgagattttccnactggtaagttaccagataatttttgaagcaactt

SEQ ID NO: 45488 - DNA, 71 bp, chicken (Gallus Gallus)
  misc_feature (36): n=a or g
ctttcaagatcctcagaagagcttatttttgaggtntagtgtttaattgccataacaggaacatcagcgac

SEQ ID NO: 45489 - DNA, 71 bp, chicken (Gallus Gallus)
  misc_feature (36): n=c or t
acagtattactatatacagagtctataaagccctantgagatcactctccccacatgctcacagtacagaa

SEQ ID NO: 45490 - DNA, 71 bp, chicken (Gallus Gallus)
  misc_feature (36): n=a or g
cctgtagctcaaggagataagcttcagtaaaacacngggagctgacagcgtggcctcagaggagaagagca

SEQ ID NO: 45491 - DNA, 71 bp, chicken (Gallus Gallus)
  misc_feature (36): n=a or g
tttttataaagtttacacagagacttatgaatacangctaaactcttgaaatggtagctaaatagctcctc

SEQ ID NO: 45492 - DNA, 71 bp, chicken (Gallus Gallus)
  misc_feature (36): n=a or c
tttggctattcactcattacaaagaaatgccatatnctgagtactcgcacatgagcaaatgtttacttgcc

SEQ ID NO: 45493 - DNA, 71 bp, chicken (Gallus Gallus)
  misc_feature (36): n=c or t
aatctgcagtactttcctctttatcagctctaagcngatgtgcctcaccagcacaggactcaattcaaaca

SEQ ID NO: 45494 - DNA, 71 bp, chicken (Gallus Gallus)
  misc_feature (36): n=a or g
acattaaattaaagccagaaagtaagcaagtaatcngtttgtttttttttctctatttctctttctaaagc

SEQ ID NO: 45495 - DNA, 71 bp, chicken (Gallus Gallus)
  misc_feature (36): n=a or g
tgttgtactatcacctcaatagcacttacacctcanaaagagagagaagagtctgatatagtgtacataga

SEQ ID NO: 45496 - DNA, 71 bp, chicken (Gallus Gallus)
  misc_feature (36): n=c or t
tataaaaccatcactgctaaatacctaaccaaatgnagaggcatacagagagagaattcatcaaattcacc

SEQ ID NO: 45497 - DNA, 71 bp, chicken (Gallus Gallus)
  misc_feature (36): n=a or g
gacctactacttctaataagaaaaacaccttttgancttgcttggaatatgaaacacaacctcaaagaagc

SEQ ID NO: 45498 - DNA, 71 bp, chicken (Gallus Gallus)
  misc_feature (36): n=a or c
aaactgtaagtaattaaaaccactgtcccctcctgnacactatcttgcagacatgatgtctacacatctat

SEQ ID NO: 45499 - DNA, 71 bp, chicken (Gallus Gallus)
  misc_feature (36): n=a or g
ataactaatctggagcaagcaatgagctcagtaccnataggaatctgctatgaacgcaggaaaaaaagtaa

SEQ ID NO: 45500 - DNA, 71 bp, chicken (Gallus Gallus)
  misc_feature (36): n=a or g
atatttctcacttttcatgaaattctgttaccacantttgatacaacatgatacatccacagacctacacc

SEQ ID NO: 45501 - DNA, 71 bp, chicken (Gallus Gallus)
  misc_feature (36): n=a or g
gatgtctccagcgttttggaaacacgtagttaggcntatacagctgttcctgaggcaaatcaatatgacag

SEQ ID NO: 45502 - DNA, 71 bp, chicken (Gallus Gallus)
  misc_feature (36): n=a or g
agaaatacaaacagcacctgaatgtggataaggggnaagatctagtcttgtctatgggactcttagtgatg

SEQ ID NO: 45503 - DNA, 71 bp, chicken (Gallus Gallus)
  misc_feature (36): n=c or t
gcacagcaacttcagcagacagtgggagctgtttgnaaggtggcttgctctgtgccttcgctttcagttgc

SEQ ID NO: 45504 - DNA, 71 bp, chicken (Gallus Gallus)
  misc_feature (36): n=a or g
ataacacaatagagagttctgattacagaccacacnaaggagggataagatttgttttcctgctaatacat

SEQ ID NO: 45505 - DNA, 71 bp, chicken (Gallus Gallus)
  misc_feature (36): n=a or g
cttgtatctcttgtgtcttacctgaaagccatgcanagcatattcagatagttaaggatatctacgtatgg

SEQ ID NO: 45506 - DNA, 71 bp, chicken (Gallus Gallus)
  misc_feature (36): n=c or t
aagcctggctcagatttgagcccaaatcatgctctncaggtacagcttttctgtgagagtagtgcactttg

SEQ ID NO: 45507 - DNA, 71 bp, chicken (Gallus Gallus)
  misc_feature (36): n=c or t
gtttatacattcacaaaaccattgctctgatttgtntgttaaattaaggttgtttcagaacatgatcagtg

SEQ ID NO: 45508 - DNA, 71 bp, chicken (Gallus Gallus)
  misc_feature (36): n=c or t
agggggggcatgacttgtcttgtcagatctgctatngtgggactcctaagaacggtgacatcttgtgtaca

SEQ ID NO: 45509 - DNA, 71 bp, chicken (Gallus Gallus)
  misc_feature (36): n=a or g
cctgatgggttccacttccttctcacttcccccacngagtgaagtactgtaatcccagaatgacaatacct

SEQ ID NO: 45510 - DNA, 71 bp, chicken (Gallus Gallus)
  misc_feature (36): n=a or g
aaatgctatatggagactgtctttttggataaatgntggtagtacaggcctattgtttgagcatttaactg

SEQ ID NO: 45511 - DNA, 71 bp, chicken (Gallus Gallus)
  misc_feature (36): n=a or g
gctattggtagctaattaggatacgtgacaaatacnttggcctctgaacagtgcactcctcttggcaaaga

SEQ ID NO: 45512 - DNA, 71 bp, chicken (Gallus Gallus)
  misc_feature (36): n=c or t
gcagggaggaaattcctaagtcacctttgttccacncagggaaaacctttatttctcctaacagaattaac

SEQ ID NO: 45513 - DNA, 71 bp, chicken (Gallus Gallus)
  misc_feature (36): n=a or g
aaaatgatgcttcttccatggagagttttctgaagnaaggttgttgctttgcccttcctacctaaggcaga

SEQ ID NO: 45514 - DNA, 71 bp, chicken (Gallus Gallus)
  misc_feature (36): n=g or t
tatttaaaagaaatgtaactgagaagtggagatctncttaagctcttgtgaaatacctggtgtttggaact

SEQ ID NO: 45515 - DNA, 71 bp, chicken (Gallus Gallus)
  misc_feature (36): n=c or t
aaactttttcttaataaaaacgataacaatgtcctnaccacctcacaagagagtttgaagctcttagtact

SEQ ID NO: 45516 - DNA, 71 bp, chicken (Gallus Gallus)
  misc_feature (36): n=a or g
actaactctacacgcaacagttgaaaaaaaagttangtttcctgaggactacaaaaatagtttttgaaata

SEQ ID NO: 45517 - DNA, 71 bp, chicken (Gallus Gallus)
  misc_feature (36): n=c or t
agtagcagttacaggatggcttctccaaacctcacngcaggctttgcactgcacttacagctgaccattgg

SEQ ID NO: 45518 - DNA, 71 bp, chicken (Gallus Gallus)
  misc_feature (36): n=c or t
ccctaaatgcaaacaaatcagaaggcctatcctttntgcccaaacccccttttgcagtgctcccacaggag

SEQ ID NO: 45519 - DNA, 71 bp, chicken (Gallus Gallus)
  misc_feature (36): n=a or g
gtttgaagctgcagcttggctgccaccgtgtcggcnaaaagaaagaattcaggcaccatgtcatccagtac

SEQ ID NO: 45520 - DNA, 71 bp, chicken (Gallus Gallus)
  misc_feature (36): n=g or t
ttgagagctgggagagcagcaaggcaagactcacanctttatcgcaagcagagccagaagctggaaggtgc

SEQ ID NO: 45521 - DNA, 71 bp, chicken (Gallus Gallus)
  misc_feature (36): n=c or t
atggtaacagttggaagagcgtaagcccccttcctncgcagccatgaaaggactccttcgtcccagcagtt

SEQ ID NO: 45522 - DNA, 71 bp, chicken (Gallus Gallus)
  misc_feature (36): n=c or t
tgggcagaaggaatgtgtatgtgtttgcacaagccngtgttaagtagcctttgtgaactcaattgatttct

SEQ ID NO: 45523 - DNA, 71 bp, chicken (Gallus Gallus)
  misc_feature (36): n=c or t
cctaaacctaaccaatctgtagcccataaaagtggnggcctccagctcattaacaactgcttctgaatggg

SEQ ID NO: 45524 - DNA, 71 bp, chicken (Gallus Gallus)
  misc_feature (36): n=c or t
gcagaacagtcaaataatacagaaaagtaggacttntgaattgtttatagtggtgtcactacttccaactt

SEQ ID NO: 45525 - DNA, 71 bp, chicken (Gallus Gallus)
  misc_feature (36): n=a or g
ttatagctccattatttgtcaaccacatctcctaantacgtctaaagctcttacttaatactagtgttggg

SEQ ID NO: 45526 - DNA, 71 bp, chicken (Gallus Gallus)
  misc_feature (36): n=c or t
ccgtgcacataaacacatttctacacacagacacanatgcaatcctccaatataagcagagaaaaagggaa

SEQ ID NO: 45527 - DNA, 71 bp, chicken (Gallus Gallus)
  misc_feature (36): n=g or t
gtacgtgctgtaaatgcatcttgacaatagtttgcntctgtgtattatggactcataatacgtatttattt

SEQ ID NO: 45528 - DNA, 71 bp, chicken (Gallus Gallus)
  misc_feature (36): n=c or t
cttaaaatatatcttttactgcattcagctaattanatggaacttcttcagatgtgagaatacatcttatt

SEQ ID NO: 45529 - DNA, 71 bp, chicken (Gallus Gallus)
  misc_feature (36): n=a or g
cgtctgtctgatgtcaacggacagctattttcctcntatctcctacgtctgttttgcaacattacaaggag

SEQ ID NO: 45530 - DNA, 71 bp, chicken (Gallus Gallus)
  misc_feature (36): n=a or g
cagccctgaatgatcaacactgatctttattattcnagggtaagaatgtaccgctctggtttaccaaaagt

SEQ ID NO: 45531 - DNA, 71 bp, chicken (Gallus Gallus)
  misc_feature (36): n=c or t
ataggttcctgcattggttttatcctagaagactangatttttaacaccttttttcttacatttgatgggg

SEQ ID NO: 45532 - DNA, 71 bp, chicken (Gallus Gallus)
  misc_feature (36): n=a or g
tcagaaattaccatttattttacagcccaatacatnacgtgttacatcatcaacatggagagcctatgaac

SEQ ID NO: 45533 - DNA, 71 bp, chicken (Gallus Gallus)
  misc_feature (36): n=a or g
ttgaagacttgggtacaaaacacttcacatcagccnaccacaccagtgacctgcagaaccagccttctaga

SEQ ID NO: 45534 - DNA, 71 bp, chicken (Gallus Gallus)
  misc_feature (36): n=c or t
actcttcattcagcacctgcacagtgcaaactacangggcactgcagcaggcaaggtccaaacacctcact

SEQ ID NO: 45535 - DNA, 71 bp, chicken (Gallus Gallus)
  misc_feature (36): n=c or t
cctataggatataacattgttttggttgaagtacgnaccacactttgtagctctagatttcacctcgttat

SEQ ID NO: 45536 - DNA, 71 bp, chicken (Gallus Gallus)
  misc_feature (36): n=g or t
tctctaccttcacgtcctgaattactataacatcanaatacaacatttctttgaggggggcatggtctatt

SEQ ID NO: 45537 - DNA, 71 bp, chicken (Gallus Gallus)
  misc_feature (36): n=c or t
acatgggcacatttaacactgctccggtcagacacngaagtcatttgagtacaacatcacgcatattaaca

SEQ ID NO: 45538 - DNA, 71 bp, chicken (Gallus Gallus)
  misc_feature (36): n=a or c
ataggctagcctgggagtcaacctagtggaaaattnagtttctttatctcatccctactttttacagaaga

SEQ ID NO: 45539 - DNA, 71 bp, chicken (Gallus Gallus)
  misc_feature (36): n=a or g
tgtattctgagaaggaaagtttctacacagacctgnggaaccttgttctcataatacagattagggttttg

SEQ ID NO: 45540 - DNA, 71 bp, chicken (Gallus Gallus)
  misc_feature (36): n=a or c
tacagaaaaggcttggaattttctgtaaatcagatncatatttatatagtataaggctacacagtagacac

SEQ ID NO: 45541 - DNA, 71 bp, chicken (Gallus Gallus)
  misc_feature (36): n=a or g
tagatgatgcaaatatttcagttccttaagcctgancttgagatgttgcactcctcacggctggagagaag

SEQ ID NO: 45542 - DNA, 71 bp, chicken (Gallus Gallus)
  misc_feature (36): n=c or t
taacccactctttatctcagttaattcagagcccgngtacaggacctctcccaccctctcaagacctttca

SEQ ID NO: 45543 - DNA, 71 bp, chicken (Gallus Gallus)
  misc_feature (36): n=a or g
cgggtcctcatctcccccagcagggcctggctgcgncctcggctcttttggcccatctcaaagacggaccc

SEQ ID NO: 45544 - DNA, 71 bp, chicken (Gallus Gallus)
  misc_feature (36): n=a or g
cccaaactgggaggcttaggaagccaataaccagcncttctgagcggagcactttgctttttgcttctttg

SEQ ID NO: 45545 - DNA, 71 bp, chicken (Gallus Gallus)
  misc_feature (36): n=a or g
tgcacacgatacaggtgaaactgatgtgaaggatgnaattcttattgtcagacagcatagctgggagctgc

SEQ ID NO: 45546 - DNA, 71 bp, chicken (Gallus Gallus)
  misc_feature (36): n=c or t
tgccatacagcattcacaaggaattgtcagaaatanggtctgtgtcctgaaattcctgtttttttcccccc

SEQ ID NO: 45547 - DNA, 71 bp, chicken (Gallus Gallus)
  misc_feature (36): n=c or t
ggagaaggaacaggttgctcttccaaaataacatgngattttttgcatgttaaaaaaatgatatatgaaaa

SEQ ID NO: 45548 - DNA, 71 bp, chicken (Gallus Gallus)
  misc_feature (36): n=a or g
gacaacgtgcatctgcagcccacttctcccacaccnttataccatttgatcattcacctggcacacagagg

SEQ ID NO: 45549 - DNA, 71 bp, chicken (Gallus Gallus)
  misc_feature (36): n=c or t
atttcaaatcagattcctgttagcactgtcacagcntgcagaataaggagctagacccagagaggtggtgg

SEQ ID NO: 45550 - DNA, 71 bp, chicken (Gallus Gallus)
  misc_feature (36): n=c or t
ccatttaactagtctcttttttcaattaatttatcnttgtttctgctaggataaggaatacgtaaattgct

SEQ ID NO: 45551 - DNA, 71 bp, chicken (Gallus Gallus)
  misc_feature (36): n=c or t
gaaggtctcagcacagatgttctgcacttgtgctgngagcccactgtcctcgtgccataccaacgtgtccc

SEQ ID NO: 45552 - DNA, 71 bp, chicken (Gallus Gallus)
  misc_feature (36): n=a or g
agcagggtcaccagcagcaatggaatactctgctangtaccgacgtgcccttcactgcagcaatatgcctg

SEQ ID NO: 45553 - DNA, 71 bp, chicken (Gallus Gallus)
  misc_feature (36): n=a or c
tgctgctgcttttctcccacgcagtagcttgacaangcaacacctggaacattgactttggctggagggca

SEQ ID NO: 45554 - DNA, 71 bp, chicken (Gallus Gallus)
  misc_feature (36): n=a or g
tcgagtcagcatctcttaaatgatgtcagcaagganacaggtgtgcatcagtcatccacagagacccctag

SEQ ID NO: 45555 - DNA, 71 bp, chicken (Gallus Gallus)
  misc_feature (36): n=a or g
accaaaaccaatcattactgatatgttattgaaagnttctcagggatattttcactaggtttataattgtt

SEQ ID NO: 45556 - DNA, 71 bp, chicken (Gallus Gallus)
  misc_feature (36): n=a or g
gtaactttgacataggtataattaacatgaatgccnaacagctgttgcagtggggctttggaggctgtggc

SEQ ID NO: 45557 - DNA, 71 bp, chicken (Gallus Gallus)
  misc_feature (36): n=c or t
acctgggctggaggaatagatcaccttaaaggtacnagagagctctcagatgtggggaagatccattgctg

SEQ ID NO: 45558 - DNA, 71 bp, chicken (Gallus Gallus)
  misc_feature (36): n=a or g
gtgtagtctgtagcaataaatacgtccaggcagtcntaaaatgttcccatcaggtagtaccagcttgttct

SEQ ID NO: 45559 - DNA, 71 bp, chicken (Gallus Gallus)
  misc_feature (36): n=c or t
gtgccttttgagattgggattgtgttgcatgtaccncattgtagaggggatctcccataatatagagatgt

SEQ ID NO: 45560 - DNA, 71 bp, chicken (Gallus Gallus)
  misc_feature (36): n=c or t
ttgtaatcagaatccaaaatgaatgagggactctanaagcacggcattattgtatactaattctcagctca

SEQ ID NO: 45561 - DNA, 71 bp, chicken (Gallus Gallus)
  misc_feature (36): n=a or g
gcagaacctctccaggtcactggttgccatctgggnaaatgacatctcaggtctttctctgatttgtactc

SEQ ID NO: 45562 - DNA, 71 bp, chicken (Gallus Gallus)
  misc_feature (36): n=c or t
tttccttgctgacttgtacaggacagacagccttantgttatcttcctcctgtgaggatttcacctctgga

SEQ ID NO: 45563 - DNA, 71 bp, chicken (Gallus Gallus)
  misc_feature (36): n=c or t
atgttcggagggaaaagtgccatggctttttaacangaaccctttcctgaataattttccaggaaaattgt

SEQ ID NO: 45564 - DNA, 71 bp, chicken (Gallus Gallus)
  misc_feature (36): n=c or t
ggaaacccctctgccctgaggagggtgaaaatctgntctctttcagaatcacttgaaccttaattgctttc

SEQ ID NO: 45565 - DNA, 71 bp, chicken (Gallus Gallus)
  misc_feature (36): n=a or g
tacagggtttctgccatgtcaatgaagtgatgagcnactatgtcaaacacagcatctaaaatagttttatt

SEQ ID NO: 45566 - DNA, 71 bp, chicken (Gallus Gallus)
  misc_feature (36): n=a or g
gttgttatattgaaaatggaagtcctgttaaagtcnctctgtaattgctttgatgtgaagttatagatttc

SEQ ID NO: 45567 - DNA, 71 bp, chicken (Gallus Gallus)
  misc_feature (36): n=c or t
tcctaaaccaagattcatttagtgtcatctttatgnattgggttgtagatcgtaaaaggaatcacacccca

SEQ ID NO: 45568 - DNA, 71 bp, chicken (Gallus Gallus)
  misc_feature (36): n=c or t
gagctggactggagactgaatgaatcatctcagagnggctcagaggggataagaacttcagtgctgttcag

SEQ ID NO: 45569 - DNA, 71 bp, chicken (Gallus Gallus)
  misc_feature (36): n=a or g
cttctaatgcagggctgaagaccatccataattcangtactatccttgtacagcagcaaactgaatttgaa

SEQ ID NO: 45570 - DNA, 71 bp, chicken (Gallus Gallus)
  misc_feature (36): n=g or t
cttagaagctccttcctagcactggagagaagccanctcagagatgctcttggcatgaggcaggcagcttc

SEQ ID NO: 45571 - DNA, 71 bp, chicken (Gallus Gallus)
  misc_feature (36): n=a or g
ttgtgcatttgtgttactggtctcttgataatgggntgtacaaatggatgcgatggaacgcaaccatcaag

SEQ ID NO: 45572 - DNA, 71 bp, chicken (Gallus Gallus)
  misc_feature (36): n=a or g
cactgtgcttgagctcacttgtagagccagagcaanaaggggggatgcacactaggagatactcaccacca

SEQ ID NO: 45573 - DNA, 71 bp, chicken (Gallus Gallus)
  misc_feature (36): n=a or g
agaagacaattatcatcccatgagagcgcagccagnctgtaagtagtaactgttgtgtagctttttccatg

SEQ ID NO: 45574 - DNA, 71 bp, chicken (Gallus Gallus)
  misc_feature (36): n=a or c
cccagattttcagtataagtgttccattgcctgaanattctgtcatggaggatgtggatgaagatattagc

SEQ ID NO: 45575 - DNA, 71 bp, chicken (Gallus Gallus)
  misc_feature (36): n=a or g
aataaacataacttcttgtgacctcttgagggatcnaatgttttgacttcgctgttcttactgtggtttca

SEQ ID NO: 45576 - DNA, 71 bp, chicken (Gallus Gallus)
  misc_feature (36): n=g or t
caccgtgggccgatcccactttctggtttgcacttngtaccccagcagcactaatgcactgaaaccccact

SEQ ID NO: 45577 - DNA, 71 bp, chicken (Gallus Gallus)
  misc_feature (36): n=a or c
gatttatcagagctggaaaggatagcttacgccccncagttcattctgaatgtcgaatcccttcctcggat

SEQ ID NO: 45578 - DNA, 71 bp, chicken (Gallus Gallus)
  misc_feature (36): n=c or t
cacagatccatgccggatccatagcccactaaaacnattgtcatctttgcaggagcctcagaccaggccta

SEQ ID NO: 45579 - DNA, 71 bp, chicken (Gallus Gallus)
  misc_feature (36): n=a or g
attggcagtgacacatcatagtaccttaacagaacngaagagacatctcccagtcgttaacctcactcaac

SEQ ID NO: 45580 - DNA, 71 bp, chicken (Gallus Gallus)
  misc_feature (36): n=a or g
attttccaagatggcaagaagaagacctgtaagatnagaaagcctccacaattctgccattattattattt

SEQ ID NO: 45581 - DNA, 71 bp, chicken (Gallus Gallus)
  misc_feature (36): n=c or t
caagtttcagtaagtacacctctctgttgggtttgncttccttttagtacatagtccaaaactttgcagct

SEQ ID NO: 45582 - DNA, 71 bp, chicken (Gallus Gallus)
  misc_feature (36): n=a or g
gcacacccagcaagacaacctttcccagtttaatcngagtggcactcccattcaaaccctctgacaaccag

SEQ ID NO: 45583 - DNA, 71 bp, chicken (Gallus Gallus)
  misc_feature (36): n=g or t
agcagtaaataaatagcagcataccccctctgcttntgcagcacaggtagacagtgcatgaggagcaaaga

SEQ ID NO: 45584 - DNA, 71 bp, chicken (Gallus Gallus)
  misc_feature (36): n=a or g
accaccaaacaacttgggtttcctccagcaagttgnatgagatgaagccatagaacccaatgacaaaaaca

SEQ ID NO: 45585 - DNA, 71 bp, chicken (Gallus Gallus)
  misc_feature (36): n=c or t
aggttacattccactttttttcagatgctgtaagantttctcagtgcatcagagcatgcaagtcaggggga

SEQ ID NO: 45586 - DNA, 71 bp, chicken (Gallus Gallus)
  misc_feature (36): n=a or c
agactttgtaacaagaactgctgtaaaagacaaatnggagttttaccatcgtgagtaatttatgaggcatt

SEQ ID NO: 45587 - DNA, 71 bp, chicken (Gallus Gallus)
  misc_feature (36): n=c or t
catcacctgcagacctgaaataatgcctatctatcnaacaggtgagattagcaccacgtctcttcacgagc

SEQ ID NO: 45588 - DNA, 71 bp, chicken (Gallus Gallus)
  misc_feature (36): n=c or t
tttagaaggggacctcagtcatgctgtaacttgggnctaccttctcttcccaattgtgtgttatgaaaact

SEQ ID NO: 45589 - DNA, 71 bp, chicken (Gallus Gallus)
  misc_feature (36): n=a or c
tctgcagagttaacttgatggtggaggcttccattngggtacaaaaggagaccaggaaaaccagaaccttc

SEQ ID NO: 45590 - DNA, 71 bp, chicken (Gallus Gallus)
  misc_feature (36): n=c or t
acaaggtaagtcaaaaatatgcagaatatgcaaaanacaaaacagagtacagcataatttctcccactgtt

SEQ ID NO: 45591 - DNA, 71 bp, chicken (Gallus Gallus)
  misc_feature (36): n=c or t
catgaagggcttcacacagatgcttgaagatgaaangttcgttgctcatttcaaaagttcatgccttttcc

SEQ ID NO: 45592 - DNA, 71 bp, chicken (Gallus Gallus)
  misc_feature (36): n=a or g
ttttcagtgcatgtctaagctgtattaaatatccantatttggggtaacttctatgtgaagaatcgattaa

SEQ ID NO: 45593 - DNA, 71 bp, chicken (Gallus Gallus)
  misc_feature (36): n=c or t
aatccagaatttaattgacattaagaacttgccttntgtgtattaaaattctgccaccttggctgctctcc

SEQ ID NO: 45594 - DNA, 71 bp, chicken (Gallus Gallus)
  misc_feature (36): n=a or g
ccctcccttccagcccctgctgtctcagggcatagngggcatctcctcctgtagcagtgtgctccctgaag

SEQ ID NO: 45595 - DNA, 71 bp, chicken (Gallus Gallus)
  misc_feature (36): n=a or g
taacagtcaagaaatcaaatccaaaatggcatgagnactgagacagtctctttctctccagtactcgtaag

SEQ ID NO: 45596 - DNA, 71 bp, chicken (Gallus Gallus)
  misc_feature (36): n=c or t
acaggcagcactcctaagtcacagcatttttgtgtngcctcaagcaggcagcgaggtgcctctgtagctct

SEQ ID NO: 45597 - DNA, 71 bp, chicken (Gallus Gallus)
  misc_feature (36): n=c or t
ggagatatctgtaatctgagcactgggtcttttggntgatggtttacaacatctaatgcagcaattaactg

SEQ ID NO: 45598 - DNA, 71 bp, chicken (Gallus Gallus)
  misc_feature (36): n=a or g
agcactaaataacctcttttatactgtttatatccnaaacattcattgctggagcacagctgagcatttgc

SEQ ID NO: 45599 - DNA, 71 bp, chicken (Gallus Gallus)
  misc_feature (36): n=a or g
gctcccccagatggaggatcaagtttggaaacacanaatgtctacttaagcacttgttcagttacacaccc

SEQ ID NO: 45600 - DNA, 71 bp, chicken (Gallus Gallus)
  misc_feature (36): n=c or t
ggcttttcccctcatcttattcttgcacaaatctgngcatgtttacatcatgtggtgtgcagatgccacca

SEQ ID NO: 45601 - DNA, 71 bp, chicken (Gallus Gallus)
  misc_feature (36): n=a or g
cacaggcatgtttgaatacatggcaatttgtagacncccatagcttggcactgcaagattactgagtctgc

SEQ ID NO: 45602 - DNA, 71 bp, chicken (Gallus Gallus)
  misc_feature (36): n=c or t
ttcccggtgggatgctcaccatcacccagcttagcnctgccctgcccaattcctcctcccagtgggatgaa

SEQ ID NO: 45603 - DNA, 71 bp, chicken (Gallus Gallus)
  misc_feature (36): n=c or t
gaagagctgggagctcctggttttatggtaccaaanatctccagagtctgttcaaaggggaatttttgctg

SEQ ID NO: 45604 - DNA, 71 bp, chicken (Gallus Gallus)
  misc_feature (36): n=c or t
gagaaaagaaatggctctcataaacagctgaaatangttgggaaaacttacaagcagctttttctgagcat

SEQ ID NO: 45605 - DNA, 71 bp, chicken (Gallus Gallus)
  misc_feature (36): n=c or t
ttgctgaagtgtgatgtatttctctgaacagatttnccatgagcttagatagctgaatcaaggctgtgtgc

SEQ ID NO: 45606 - DNA, 71 bp, chicken (Gallus Gallus)
  misc_feature (36): n=a or g
ggtggcagggattgagcagagatggagaattgttcngagctgtaattgtctttcatcaagtccctgtttgg

SEQ ID NO: 45607 - DNA, 71 bp, chicken (Gallus Gallus)
  misc_feature (36): n=c or t
gctacttggaaagttagttacagaagtctagttttnttgatggcatttacagaaagttggcgcgcccttaa

SEQ ID NO: 45608 - DNA, 71 bp, chicken (Gallus Gallus)
  misc_feature (36): n=c or t
gtcactgttgctattccatgtttaaggggaaacaangaaaaaactaacaaatttaaaactaattttggaag

SEQ ID NO: 45609 - DNA, 71 bp, chicken (Gallus Gallus)
  misc_feature (36): n=g or t
aagtgttccaacagaccagtggttacatcaggaggngctgagtggttatctgtataaatgtgagaaaaaca

SEQ ID NO: 45610 - DNA, 71 bp, chicken (Gallus Gallus)
  misc_feature (36): n=a or g
accagctctaaggcctggcaatccctaggaacacantgaaaatgggtctcctcaaagcaacactttttgtg

SEQ ID NO: 45611 - DNA, 71 bp, chicken (Gallus Gallus)
  misc_feature (36): n=a or c
tcacgaaatccggttatacttcaaaagctgcttacngttacaatagttaaaaatttcatagcaccatagaa

SEQ ID NO: 45612 - DNA, 71 bp, chicken (Gallus Gallus)
  misc_feature (36): n=a or g
agagggtgactgggttcaaccaaatgtccagacccnttaagcaagattataacattaagcaagacccaaag

SEQ ID NO: 45613 - DNA, 71 bp, chicken (Gallus Gallus)
  misc_feature (36): n=c or t
gttacctctcaaagccagagccaaattaaacagagnaagccttacttcatacttcctgacctccagttctc

SEQ ID NO: 45614 - DNA, 71 bp, chicken (Gallus Gallus)
  misc_feature (36): n=a or g
attctttgttctgcttggtgtggtggtaaatgcttntgtagctttttggaccaggaggccgctgagcaagc

SEQ ID NO: 45615 - DNA, 71 bp, chicken (Gallus Gallus)
  misc_feature (36): n=a or g
tttgaacaactgccagactctggattttttcagatngtctcatctaaatttagccctttttccttctccca

SEQ ID NO: 45616 - DNA, 71 bp, chicken (Gallus Gallus)
  misc_feature (36): n=a or g
caggagatggaaacgcactcaggaaccaccatcccnaataaccccaggcccaacagagacccaaatgcaat

SEQ ID NO: 45617 - DNA, 71 bp, chicken (Gallus Gallus)
  misc_feature (36): n=c or t
tttgagccacggccttcacgaggatcagccagcacngctccacctggcccaaactcaccaccatctcctaa

SEQ ID NO: 45618 - DNA, 71 bp, chicken (Gallus Gallus)
  misc_feature (36): n=c or t
ctcttctctgttcctaggaggtctgtattaaaaaanatacataaaggccaaatgtaaaaccacttccaagg

SEQ ID NO: 45619 - DNA, 71 bp, chicken (Gallus Gallus)
  misc_feature (36): n=a or g
ccttatagtattcataaaccacagtaattcttgatntgcagacattctagctcaaaactacaattcacctt

SEQ ID NO: 45620 - DNA, 71 bp, chicken (Gallus Gallus)
  misc_feature (36): n=c or t
tcactgatactgagatatgaaaagacagacttttgncagactattcttgggaataagtttgagtgactgtt

SEQ ID NO: 45621 - DNA, 71 bp, chicken (Gallus Gallus)
  misc_feature (36): n=a or g
agcaagcaaagcacattctcatagttatcatacagnttagttgaaagatacacaatgtcagaaacctcagc

SEQ ID NO: 45622 - DNA, 71 bp, chicken (Gallus Gallus)
  misc_feature (36): n=a or g
ttcagaccagaacaatgctattttctaaattgaatnacagtgcatggttagtggttgccatttagaataaa

SEQ ID NO: 45623 - DNA, 71 bp, chicken (Gallus Gallus)
  misc_feature (36): n=a or g
attttattcagaggtcacagccgctggatgaggacntactgtagctgattctggttgttttccaaagttct

SEQ ID NO: 45624 - DNA, 71 bp, chicken (Gallus Gallus)
  misc_feature (36): n=a or c
gccattttgaataaatctaatacagcattctgagtnctagaaaggtgagaaaggtaatctagaccacaaga

SEQ ID NO: 45625 - DNA, 71 bp, chicken (Gallus Gallus)
  misc_feature (36): n=a or c
ggtttttgacatttcttgtcttagagagcaagcacnatttgaaatgttaatagagaaggagaagcaagcta

SEQ ID NO: 45626 - DNA, 71 bp, chicken (Gallus Gallus)
  misc_feature (36): n=c or t
ctagcatccctagtttatttagctggacaaattgcngcagctcgttcaagagcacatgtgtgctgatttgc

SEQ ID NO: 45627 - DNA, 71 bp, chicken (Gallus Gallus)
  misc_feature (36): n=c or t
tgcagtctgaacctatgatatgaattttacagagtnacaaatcttggggtatgtcattaagaaacaaaggc

SEQ ID NO: 45628 - DNA, 71 bp, chicken (Gallus Gallus)
  misc_feature (36): n=a or g
gatctacagaaaggagctgtggaaagcagtcacatntctcagtgctgaaagactttgccttgcaaaagtgt

SEQ ID NO: 45629 - DNA, 71 bp, chicken (Gallus Gallus)
  misc_feature (36): n=c or t
ggtgatcagtgcgagcacaatcgtgttcataaacangatcatgtacacgatgcatctcactttcatgtgca

SEQ ID NO: 45630 - DNA, 71 bp, chicken (Gallus Gallus)
  misc_feature (36): n=a or c
atgccttagcccaagcagccaagagtttttatgccntatcttagggacctgcttttgattaaggagttcca

SEQ ID NO: 45631 - DNA, 71 bp, chicken (Gallus Gallus)
  misc_feature (36): n=c or t
tgaagaatgtttttgtttccctcaccaattcagtgnttcaggtactacagccatgcaaccaacaaaaatga

SEQ ID NO: 45632 - DNA, 71 bp, chicken (Gallus Gallus)
  misc_feature (36): n=c or t
tcagatttctttctctcaaagagtcactctctatanaatcattcagtattttccattatgtatgtttggct

SEQ ID NO: 45633 - DNA, 71 bp, chicken (Gallus Gallus)
  misc_feature (36): n=c or t
tgcctgggagtggactaaatactcctgaaaaagctntttcatttgggtaaatataaatctgatctgtggtt

SEQ ID NO: 45634 - DNA, 71 bp, chicken (Gallus Gallus)
  misc_feature (36): n=c or t
attttcagtgcttgaagtgaggcggttattgctatnctgcagcttttacaagctacaacttggaatgaagt

SEQ ID NO: 45635 - DNA, 71 bp, chicken (Gallus Gallus)
  misc_feature (36): n=a or g
acaggtacttcaggcaacagcacaagtccatgcctnaagggaaactatcccctgcagctctgcgatcaccg

SEQ ID NO: 45636 - DNA, 71 bp, chicken (Gallus Gallus)
  misc_feature (36): n=c or t
tcaaatcctctgtgcgtgtattactgctcctcttgnctcactgggcccttatttgcaaagcgtctgaattc

SEQ ID NO: 45637 - DNA, 71 bp, chicken (Gallus Gallus)
  misc_feature (36): n=c or t
cacctaacagtttcagaggagactgcaggttcttgnccctcacctgttccaagggcctatcagttcaaatg

SEQ ID NO: 45638 - DNA, 71 bp, chicken (Gallus Gallus)
  misc_feature (36): n=a or g
gcgttctgtttacagcattaatgcaacgcatgatcnggcacatcttggttaaaaatgagatgtgcaatgac

SEQ ID NO: 45639 - DNA, 71 bp, chicken (Gallus Gallus)
  misc_feature (36): n=c or t
attcctgctaacaaatatccccgggtattttggaangcaaagaatgctcgcagttgtgacttttataaaat

SEQ ID NO: 45640 - DNA, 71 bp, chicken (Gallus Gallus)
  misc_feature (36): n=c or t
ggatgtaaatgtaccctccggtttgcttactcaganaaacatacccagtaaagcatgtgttcagagaggat

SEQ ID NO: 45641 - DNA, 71 bp, chicken (Gallus Gallus)
  misc_feature (36): n=c or t
tttttttttcctcgcatttattcacatttaggtaanccatagttagactattactcaattgagaataattt

SEQ ID NO: 45642 - DNA, 71 bp, chicken (Gallus Gallus)
  misc_feature (36): n=c or t
tttaagaggaccttcaaattaagcttccttattcanctggtagaaattcagaatgtagcctgacattacta

SEQ ID NO: 45643 - DNA, 71 bp, chicken (Gallus Gallus)
  misc_feature (36): n=c or t
tcttctccagccatggcttacttagaagttctgccngtttctttgctccagaagcactcggtgtcacgcaa

SEQ ID NO: 45644 - DNA, 71 bp, chicken (Gallus Gallus)
  misc_feature (36): n=a or c
aagagccacacagaagttaccaaacaccagcattanggttaattctgtgcagcgtaatgtcctttggtgca

SEQ ID NO: 45645 - DNA, 71 bp, chicken (Gallus Gallus)
  misc_feature (36): n=c or t
gagaagtgactgaagttcagacagtgaacaagtaantgagaacaagcatcagataaacccagaagctgtgc

SEQ ID NO: 45646 - DNA, 71 bp, chicken (Gallus Gallus)
  misc_feature (36): n=c or t
agaacaacacaaatgaagttacaacttggcatcaangtgaattgcaacaaatggatcttcgtcgctgtcac

SEQ ID NO: 45647 - DNA, 71 bp, chicken (Gallus Gallus)
  misc_feature (36): n=a or g
ggtgacccaaaggcaggccagtttcagtatttacantggtggtttgctaaatgagatcaagaagatcacca

SEQ ID NO: 45648 - DNA, 71 bp, chicken (Gallus Gallus)
  misc_feature (36): n=g or t
agatagcacagacccagggcaccatgttactgacantgcaggatattggataagggtataggttctagttt

SEQ ID NO: 45649 - DNA, 71 bp, chicken (Gallus Gallus)
  misc_feature (36): n=a or c
tccatcctcagtgaaactacttacaaaggttataanctgccttggaatctggttttgtattttgaggcaga

SEQ ID NO: 45650 - DNA, 71 bp, chicken (Gallus Gallus)
  misc_feature (36): n=c or t
agtggcaagtagattggttcctagtatatcgtagangctttttacagttgtcttaggaagtacaaaggttc

SEQ ID NO: 45651 - DNA, 71 bp, chicken (Gallus Gallus)
  misc_feature (36): n=a or g
agggaagactttcttgctgatcattcaggactgggncagcatttgttgttatttacgttctagcaaactta

SEQ ID NO: 45652 - DNA, 71 bp, chicken (Gallus Gallus)
  misc_feature (36): n=g or t
ttcgacaaaacctaataaaaataagctcagattccnaatgtttaagttaatctgtgataactgtgttggat

SEQ ID NO: 45653 - DNA, 71 bp, chicken (Gallus Gallus)
  misc_feature (36): n=a or g
cactgctgtagtcatcttttgttggaagcagttcantgtgccctcgtaacacaaaatgacacattatctta

SEQ ID NO: 45654 - DNA, 71 bp, chicken (Gallus Gallus)
  misc_feature (36): n=a or g
caaatctaaaggttttctttcagtcagagctaagtngtgtcagtaaaggttggatttagctatacagatca

SEQ ID NO: 45655 - DNA, 71 bp, chicken (Gallus Gallus)
  misc_feature (36): n=c or t
acagcagtaacaaccacaggaaagaagtctttccgnagtcactacagagcagcatgtaggcagaactgaat

SEQ ID NO: 45656 - DNA, 71 bp, chicken (Gallus Gallus)
  misc_feature (36): n=a or g
acattggactcatttgcagctatagcttatcacatngaagctgaatattttatgttaacactttttgttaa

SEQ ID NO: 45657 - DNA, 71 bp, chicken (Gallus Gallus)
  misc_feature (36): n=c or t
aaaagtccttttattcaccctgacatagcttagacnataaagcagaggcatttctccatgatgtgccaggt

SEQ ID NO: 45658 - DNA, 71 bp, chicken (Gallus Gallus)
  misc_feature (36): n=a or g
catgtttgcatcctaaatatacaaacctagctaagntgtattttcaaagaataggcttaagcacagaacta

SEQ ID NO: 45659 - DNA, 71 bp, chicken (Gallus Gallus)
  misc_feature (36): n=c or t
ctgaagttgcatagaaaagatgatctgtcagaattnatcagcagatgagtgattatttatcctcttatgta

SEQ ID NO: 45660 - DNA, 71 bp, chicken (Gallus Gallus)
  misc_feature (36): n=c or t
gctggaactaaatcaggaaaacttaataaataatgnggggatgcacagttgtcagcagctctgtgtaacag

SEQ ID NO: 45661 - DNA, 71 bp, chicken (Gallus Gallus)
  misc_feature (36): n=a or g
taaaaatctttaccatgttcttgtggtttctctccnatacactgaagtgcttggtggccttgctttcatca

SEQ ID NO: 45662 - DNA, 71 bp, chicken (Gallus Gallus)
  misc_feature (36): n=g or t
acaacctgtatttataacaattggattagaatgtgngctgtaggcagctggatgctaagctgtgcatttca

SEQ ID NO: 45663 - DNA, 71 bp, chicken (Gallus Gallus)
  misc_feature (36): n=c or t
atgactcattcaaagaataatgagatgtgggatccngtgttcataatggtatacagcacaacgtgatttag

SEQ ID NO: 45664 - DNA, 71 bp, chicken (Gallus Gallus)
  misc_feature (36): n=g or t
actacagttatgtttatctgaggtgaaagtttgtangtctgaagctcagaaaagtttcatgtactagacct

SEQ ID NO: 45665 - DNA, 71 bp, chicken (Gallus Gallus)
  misc_feature (36): n=g or t
ttctgtagttagggaaagtgaaaggcagaaccttcntatccatgttttcaggagtcatgttcagaagaaat

SEQ ID NO: 45666 - DNA, 71 bp, chicken (Gallus Gallus)
  misc_feature (36): n=c or t
agaaagtggaactgggtcaggatgtgacagttgctntttagctgtattcaggtatgctgaatgttggcttc

SEQ ID NO: 45667 - DNA, 71 bp, chicken (Gallus Gallus)
  misc_feature (36): n=c or t
aaaaggtttactgggctattttcagatattcacttngaatcttagcttgtcagttactttgtgttatggtg

SEQ ID NO: 45668 - DNA, 71 bp, chicken (Gallus Gallus)
  misc_feature (36): n=c or t
ccgctgtatagttatgagatagattttgtttcacanggtgaggcagaatctgcttgagccctctgttgtac

SEQ ID NO: 45669 - DNA, 71 bp, chicken (Gallus Gallus)
  misc_feature (36): n=c or t
tgattctcttaatcaactatgctcattataggttgngatatgcttcttagcacaaatactgggggataaaa

SEQ ID NO: 45670 - DNA, 71 bp, chicken (Gallus Gallus)
  misc_feature (36): n=a or g
ctcttaggtcacatacttgaatgtgactcagtgttntatcatcaaagtggttagtctgttgcagtaattaa

SEQ ID NO: 45671 - DNA, 71 bp, chicken (Gallus Gallus)
  misc_feature (36): n=a or g
tgcttcgaagagcacctttacttaatttgagttgcnggcatctccaggtgatgtgcagcctgagaaaattg

SEQ ID NO: 45672 - DNA, 71 bp, chicken (Gallus Gallus)
  misc_feature (36): n=a or c
catagatacacaattttgctcatacatttagttaangtcttgaaaaggattatctcaaaaacctcggcatt

SEQ ID NO: 45673 - DNA, 71 bp, chicken (Gallus Gallus)
  misc_feature (36): n=a or g
gttccactcaccatgaaaattaactgttgtttaccntattctctttagaataagaaaaattattcaccttg

SEQ ID NO: 45674 - DNA, 71 bp, chicken (Gallus Gallus)
  misc_feature (36): n=a or g
tttacaattaaaggctcatgttaggtcagttagcantatgtatggttgaatttaatctttggactgcttcc

SEQ ID NO: 45675 - DNA, 71 bp, chicken (Gallus Gallus)
  misc_feature (36): n=g or t
ctgaatgctgcccatgtcagatgcccatgtcataancatttggtgccagccctggcagttgcccctgcaga

SEQ ID NO: 45676 - DNA, 71 bp, chicken (Gallus Gallus)
  misc_feature (36): n=g or t
tactccacagtcagttcctgcaagagtaggaaatanctggaaagcaaaagaccctggcagagcagcagaag

SEQ ID NO: 45677 - DNA, 71 bp, chicken (Gallus Gallus)
  misc_feature (36): n=a or g
aaaatcagcaactgcgagaaaatggaattaaattgnagctgttctgggaagctgtcgcactgtggtacgga

SEQ ID NO: 45678 - DNA, 71 bp, chicken (Gallus Gallus)
  misc_feature (36): n=c or t
tttatgaggcagtactgcaggaagaaatggttacgntgaagtgatgaaacatacctgtattcactgtgtaa

SEQ ID NO: 45679 - DNA, 71 bp, chicken (Gallus Gallus)
  misc_feature (36): n=c or t
cttcagaagctcgccagtacacccggataccattantgccaagtctatatagcttcactccagaaggacag

SEQ ID NO: 45680 - DNA, 71 bp, chicken (Gallus Gallus)
  misc_feature (36): n=g or t
accaacaagtttccatgttcatcttcttcagttganatatttcctggtgcacaaggaactggaaagaaaaa

SEQ ID NO: 45681 - DNA, 71 bp, chicken (Gallus Gallus)
  misc_feature (36): n=c or t
aatgacatttatgatgtcagcatacctctgcattgnctaggatactaacgttttttctctctgtaatttta

SEQ ID NO: 45682 - DNA, 71 bp, chicken (Gallus Gallus)
  misc_feature (36): n=c or t
tgtttgttccttctggtatgattgatatgtttgtgnggttgcaaagtagaggtgagcattttaccagtaga

SEQ ID NO: 45683 - DNA, 71 bp, chicken (Gallus Gallus)
  misc_feature (36): n=a or g
tccaggaacacaagcagaagatattccgtactgctnaagaggaagtcaaattatgcactgccatacaaacc

SEQ ID NO: 45684 - DNA, 71 bp, chicken (Gallus Gallus)
  misc_feature (36): n=c or t
atttaccaaattttttcaataatccaactaaacgcnctcattcatacttatgctttagtattctagcatat

SEQ ID NO: 45685 - DNA, 71 bp, chicken (Gallus Gallus)
  misc_feature (36): n=c or t
atgttgcaaatttcagagccactaataatagaaacnaaacagcagacaagttatctgaagttaaaaaagca

SEQ ID NO: 45686 - DNA, 71 bp, chicken (Gallus Gallus)
  misc_feature (36): n=a or g
catgagaacgttcttacccattttaactgcaaatancagctgtctttcagcagatgaagttgaatgctcat

SEQ ID NO: 45687 - DNA, 71 bp, chicken (Gallus Gallus)
  misc_feature (36): n=c or t
ttaaataattggtaggtgaaaggtttttattatcanactgaatatctttcttccatgggtttttaagtcca

SEQ ID NO: 45688 - DNA, 71 bp, chicken (Gallus Gallus)
  misc_feature (36): n=a or c
cagctgaattttacttctcttgttgtgacgtttttnctaaccattctaaaatgagattcactttacttacc

SEQ ID NO: 45689 - DNA, 71 bp, chicken (Gallus Gallus)
  misc_feature (36): n=c or t
gttaaagatagttgcatcagctttctcacattcccngtatttagagggcaagatttgttaatttcatttgt

SEQ ID NO: 45690 - DNA, 71 bp, chicken (Gallus Gallus)
  misc_feature (36): n=c or t
ggaacatcctcaattcccagcagaggttttggtacngagattagactgctgcgtaaacagtaacagcagct

SEQ ID NO: 45691 - DNA, 71 bp, chicken (Gallus Gallus)
  misc_feature (36): n=c or t
gtgtgtgggattatgtattctgaaatctgcaaatcnagattgataacttagcactttcaggttaagactga

SEQ ID NO: 45692 - DNA, 71 bp, chicken (Gallus Gallus)
  misc_feature (36): n=a or g
gatacgctttgttatttatctaagcaactctggtcnttgaatgaggtttcaagagacaaggtaaacagagg

SEQ ID NO: 45693 - DNA, 71 bp, chicken (Gallus Gallus)
  misc_feature (36): n=c or t
atcctagtccggggctgtgcctttacctgtgaagcntcaattatagcccagaggaataatatttccacagc

SEQ ID NO: 45694 - DNA, 71 bp, chicken (Gallus Gallus)
  misc_feature (36): n=c or t
agtcacacttaacaatctctatacttaattgtcagntgagaactttagtttcacagggctctgcctaatct

SEQ ID NO: 45695 - DNA, 71 bp, chicken (Gallus Gallus)
  misc_feature (36): n=a or g
ttaaagctttctttgacagcagctatccatttaaantaatttgaatgttcttgtatgtgctgcaacttctg

SEQ ID NO: 45696 - DNA, 71 bp, chicken (Gallus Gallus)
  misc_feature (36): n=a or g
ttgatcaaacaatcttctacgtttccaaagaactcngttttaaaacaagatgtaaaacgatcatttggctc

SEQ ID NO: 45697 - DNA, 71 bp, chicken (Gallus Gallus)
  misc_feature (36): n=a or g
tgctgagaatgagggttttcacactaccacattgcntttgctttatctgtagattgtaaggggagggcctc

SEQ ID NO: 45698 - DNA, 71 bp, chicken (Gallus Gallus)
  misc_feature (36): n=c or t
ccaaataaagcagttcagattgcggtcagcaggtcntgggatctttcagaaagggcagagctgtcctgcac

SEQ ID NO: 45699 - DNA, 71 bp, chicken (Gallus Gallus)
  misc_feature (36): n=a or g
tggggaaaaaaaacacccatgactaaaggagctagnaatagcctaaattcaacccaaatatttattcattg

SEQ ID NO: 45700 - DNA, 71 bp, chicken (Gallus Gallus)
  misc_feature (36): n=c or t
gctggaaacccagtttgaaatcaccactgaagagcntccagggacatccaacagagcagcaggcatcctgg

SEQ ID NO: 45701 - DNA, 71 bp, chicken (Gallus Gallus)
  misc_feature (36): n=a or g
accgttaattccaaataactctaccaaaggcaaacnattccataactaaaaaaattaaacgtggaattaca

SEQ ID NO: 45702 - DNA, 71 bp, chicken (Gallus Gallus)
  misc_feature (36): n=c or t
ggtctttgccctccagtgctgacgattactgcttgngctgggcagttgaatctacagctgcagtgaacgct

SEQ ID NO: 45703 - DNA, 71 bp, chicken (Gallus Gallus)
  misc_feature (36): n=a or g
gaaggattgtaattctcaggacttggatttctgttncagatttgataagctatgataaaggtcagaaatgc

SEQ ID NO: 45704 - DNA, 71 bp, chicken (Gallus Gallus)
  misc_feature (36): n=a or c
atcacccatgagacaaaggtagcagaacaagatatntgagttttacttctgcttatctactttctgacttg

SEQ ID NO: 45705 - DNA, 71 bp, chicken (Gallus Gallus)
  misc_feature (36): n=c or t
ataaaacaagcagctcccagaggatttttcttttgntttcctttcctctcgctccctctaccccagattac

SEQ ID NO: 45706 - DNA, 71 bp, chicken (Gallus Gallus)
  misc_feature (36): n=g or t
gtttttctccctctctcatctgtcatctttcgcttntggtaacaatgcaaaggattgtcaactaagcaagt

SEQ ID NO: 45707 - DNA, 71 bp, chicken (Gallus Gallus)
  misc_feature (36): n=c or t
caaatctttattaaatgcatgggaacatttaacttnacagcataccctgaagttcttaatgttttgtaatg

SEQ ID NO: 45708 - DNA, 71 bp, chicken (Gallus Gallus)
  misc_feature (36): n=c or t
tttaacccaagtcattgttgtgacctgcctgacaangcagaccttcaaaatggagaacaggggactgtatc

SEQ ID NO: 45709 - DNA, 71 bp, chicken (Gallus Gallus)
  misc_feature (36): n=c or t
atgctgcatttagggtcatatatgcaactgtactanaagccaacttgtgcatctagaaatggtgtttcttt

SEQ ID NO: 45710 - DNA, 71 bp, chicken (Gallus Gallus)
  misc_feature (36): n=a or g
gcctgccaaggtgacctggagcagcccccaggaggntcctgttatgtgttcagtaagtgtctagttcctta

SEQ ID NO: 45711 - DNA, 71 bp, chicken (Gallus Gallus)
  misc_feature (36): n=a or c
cattttaaatattctctaacattttacaaactcccnaatgtcagacagtgggtaatttgcctagtgccaca

SEQ ID NO: 45712 - DNA, 71 bp, chicken (Gallus Gallus)
  misc_feature (36): n=a or g
cgaataaatcaaattaaatttctcacttgcccttantgcctttcaaatgcaagtcaagcctcttgactgtt

SEQ ID NO: 45713 - DNA, 71 bp, chicken (Gallus Gallus)
  misc_feature (36): n=a or g
acctcatttgtccagcaaatgttcttggaagctacncaggcataacaaatattgactctcaccattagggt

SEQ ID NO: 45714 - DNA, 71 bp, chicken (Gallus Gallus)
  misc_feature (36): n=c or t
ccctcgttccgtggctaataatttaattgctggtgngtgtgtgatctgggacgccttatggtgctgactgt

SEQ ID NO: 45715 - DNA, 71 bp, chicken (Gallus Gallus)
  misc_feature (36): n=c or t
gttttttgtggtttctttttctgcattacgttctcntgagaaatatgaggttggtgaactggttaatattc

SEQ ID NO: 45716 - DNA, 71 bp, chicken (Gallus Gallus)
  misc_feature (36): n=c or t
cctcacaacactgctttagacagcaaaactgttaanagtagaaatgaagtttctacttgaaatgaaccaag

SEQ ID NO: 45717 - DNA, 71 bp, chicken (Gallus Gallus)
  misc_feature (36): n=c or t
caccacttgctagatactctagtgtcagaatgatantctggagaatggaaatagctgcgtcaaagagaggg

SEQ ID NO: 45718 - DNA, 71 bp, chicken (Gallus Gallus)
  misc_feature (36): n=a or g
gtagagaagccctcatctagagctttttttcagtgnatatctaagataggttgctgttggatttgataatc

SEQ ID NO: 45719 - DNA, 71 bp, chicken (Gallus Gallus)
  misc_feature (36): n=g or t
ataataaaataagattccacactaccagtttgtctntattactccggttcgtgttgtacagctcattctca

SEQ ID NO: 45720 - DNA, 71 bp, chicken (Gallus Gallus)
  misc_feature (36): n=c or t
cttgctgatgagcagttggtgtgaaactccaactcnggaagatttgcagttcgttttcctctctttataac

SEQ ID NO: 45721 - DNA, 71 bp, chicken (Gallus Gallus)
  misc_feature (36): n=a or g
ctgtcttgtcatctttgctgttcctagtgaggtgcngggaaatgactcacggcgtggtgtgtcctcctttg

SEQ ID NO: 45722 - DNA, 71 bp, chicken (Gallus Gallus)
  misc_feature (36): n=c or t
tctgctgcttatgagctagcttgtcaaagtacattntaaagaactttcagaataactttgaagtgtttcgt

SEQ ID NO: 45723 - DNA, 71 bp, chicken (Gallus Gallus)
  misc_feature (36): n=c or t
atactggggccagcttgattcaccagtataaatgtngttctctggcttttgctgtctgcagaaggtggaag

SEQ ID NO: 45724 - DNA, 71 bp, chicken (Gallus Gallus)
  misc_feature (36): n=c or t
tctgcacacaggctattagaatgcatatgatattgngtagaactcatgggatagcttaattaaggtgctct

SEQ ID NO: 45725 - DNA, 71 bp, chicken (Gallus Gallus)
  misc_feature (36): n=a or g
tggaaagcgctgcaagttaaaatgttagtgcaaacntcaaatagtttgcacggtgcatagaatagtgtaat

SEQ ID NO: 45726 - DNA, 71 bp, chicken (Gallus Gallus)
  misc_feature (36): n=c or t
ctctatctgaatcccaagcctataacgtctgagtanagagatccctctgtcacctcattgacaatcttggt

SEQ ID NO: 45727 - DNA, 71 bp, chicken (Gallus Gallus)
  misc_feature (36): n=c or t
aggaaaacgtaatgtaaatatacatagctcatatanctgagcttataattttacttttcactatcttgaat

SEQ ID NO: 45728 - DNA, 71 bp, chicken (Gallus Gallus)
  misc_feature (36): n=c or t
atatggtatatataaagttgaataatatttatcacncaatctttgatcccaaagtccctgtatgcatcaca

SEQ ID NO: 45729 - DNA, 71 bp, chicken (Gallus Gallus)
  misc_feature (36): n=a or c
tcaataatttgatttctcaagtaccagcaactgctnatccctcagagatcaataattaagtgatacctctt

SEQ ID NO: 45730 - DNA, 71 bp, chicken (Gallus Gallus)
  misc_feature (36): n=a or g
tccatacatgtaaaaagtctgtcctaccactggtcntggagaaggtgaaaaaacatctaacctatccctgt

SEQ ID NO: 45731 - DNA, 71 bp, chicken (Gallus Gallus)
  misc_feature (36): n=g or t
tattccatcttatcaaaagcagatctttcatgtagnttactagagagatatgcctctgcactgttgtgtct

SEQ ID NO: 45732 - DNA, 71 bp, chicken (Gallus Gallus)
  misc_feature (36): n=a or g
tcaccacattccacgttttagaagtttttcagaagngagtagagggccctattttctcaataagagatttc

SEQ ID NO: 45733 - DNA, 71 bp, chicken (Gallus Gallus)
  misc_feature (36): n=a or c
agttaagtaactgtggcagaatccatagtgaacatnagtagaacaattttatcaatgagctaagaccataa

SEQ ID NO: 45734 - DNA, 71 bp, chicken (Gallus Gallus)
  misc_feature (36): n=a or c
gtgggagaaggaaactcaagtgcagttcctttaacncccacattttatagcctgttcaggactgctttggt

SEQ ID NO: 45735 - DNA, 71 bp, chicken (Gallus Gallus)
  misc_feature (36): n=c or t
actacatttccacaatgttatatcactttactcaangaaaacttcaagtgagcaaataattttttagtcaa

SEQ ID NO: 45736 - DNA, 71 bp, chicken (Gallus Gallus)
  misc_feature (36): n=g or t
gagtgtttctcattgtgaagttcataaccagaaganagctgtgcagagaaagcagtctggtgacacgggga

SEQ ID NO: 45737 - DNA, 71 bp, chicken (Gallus Gallus)
  misc_feature (36): n=c or t
aggcaggttttacagagaaaactcaaagagctttcnagacttgcaaaatgaagaatagtgtcactaccaat

SEQ ID NO: 45738 - DNA, 71 bp, chicken (Gallus Gallus)
  misc_feature (36): n=c or t
tcaagagtgagcaaaattataagtcagtggaaagangacccccaaaggtgtcaatcagtttatacaaaatc

SEQ ID NO: 45739 - DNA, 71 bp, chicken (Gallus Gallus)
  misc_feature (36): n=a or g
tttcattctacatggatttgtggagtgcctttcccnttgaaatgttgccagggaaaggaaccacatgtatt

SEQ ID NO: 45740 - DNA, 71 bp, chicken (Gallus Gallus)
  misc_feature (36): n=a or g
tatttaggtggagcaaggagtagctttctaatagcnttagtacatgatggtatcctatttcaatccttgtt

SEQ ID NO: 45741 - DNA, 71 bp, chicken (Gallus Gallus)
  misc_feature (36): n=c or t
acaaaaatgactataccagagattcaaaaagacaancctaacagccttcaaagtgaaaccatttgctctaa

SEQ ID NO: 45742 - DNA, 71 bp, chicken (Gallus Gallus)
  misc_feature (36): n=a or g
tcaggcaacgcctgctgaatcaggtcctggggaacnggaagctgcaggagacacaagatgatgcaagggac

SEQ ID NO: 45743 - DNA, 71 bp, chicken (Gallus Gallus)
  misc_feature (36): n=c or t
ttactgctacctatctttgtttcatccagattctcntcttactaactacattaacaacattaacaagagaa

SEQ ID NO: 45744 - DNA, 71 bp, chicken (Gallus Gallus)
  misc_feature (36): n=c or t
ccagcacagcatgttgaatgcctataaaatctgccnacagagtaagcaacagaaccgtgaaaagtaaatat

SEQ ID NO: 45745 - DNA, 71 bp, chicken (Gallus Gallus)
  misc_feature (36): n=c or t
aaatacaagttcagagattctaaaatttggcgagantctcaaccatgaaaatgtacagtaagctctggttg

SEQ ID NO: 45746 - DNA, 71 bp, chicken (Gallus Gallus)
  misc_feature (36): n=a or g
ctgggtccttaccatagatattggcacataaccatngaagtagataatagtagataatgaggaacaagcaa

SEQ ID NO: 45747 - DNA, 71 bp, chicken (Gallus Gallus)
  misc_feature (36): n=c or t
ttgttgtcatacaggcattgcatatatgtattcttncttcaaaaattttctttagagtttctcaaactatt

SEQ ID NO: 45748 - DNA, 71 bp, chicken (Gallus Gallus)
  misc_feature (36): n=a or c
cagggctacctagagtgatactctaataaaaatgtnatgtatatcacacaaatgaggcctggcatatccag

SEQ ID NO: 45749 - DNA, 71 bp, chicken (Gallus Gallus)
  misc_feature (36): n=g or t
tatgtgggacacaacaaaccaaactcaatcattcanttgtatcacgtgtgcaaggaaggggaatgaaaaca

SEQ ID NO: 45750 - DNA, 71 bp, chicken (Gallus Gallus)
  misc_feature (36): n=a or g
gtcttcttgctaatgaatataaacagagtttataancagtgtgataggaatgacaaagctggttgtaatgg

SEQ ID NO: 45751 - DNA, 71 bp, chicken (Gallus Gallus)
  misc_feature (36): n=g or t
taatgtattttgtcattaatacctttggacttaagnaattcagtatgatgtctctcacatttttcaggaac

SEQ ID NO: 45752 - DNA, 71 bp, chicken (Gallus Gallus)
  misc_feature (36): n=a or c
agtagaatttccactggtactcagaatttccagccncattaccttgaagcattatcattagtgctactctg

SEQ ID NO: 45753 - DNA, 71 bp, chicken (Gallus Gallus)
  misc_feature (36): n=a or g
tttgtctttatcttagttatggaaatgtagctaggnttacaggaaacactaaataacattgtatttttttc

SEQ ID NO: 45754 - DNA, 71 bp, chicken (Gallus Gallus)
  misc_feature (36): n=a or g
agaggcacctgacttaagattcattctacagtcccnagcaatctctcactgctagcattggtctgttcctc

SEQ ID NO: 45755 - DNA, 71 bp, chicken (Gallus Gallus)
  misc_feature (36): n=a or g
tgaggttggtggatttgaacctataacctgaattangaatgctcttctcagttttcatattttttcaccgt

SEQ ID NO: 45756 - DNA, 71 bp, chicken (Gallus Gallus)
  misc_feature (36): n=a or g
cataaatgcataccaggaagggctgtctgctcagcnagacagataatgcaatatattcccctcaaaaaact

SEQ ID NO: 45757 - DNA, 71 bp, chicken (Gallus Gallus)
  misc_feature (36): n=c or t
gcaattagctcaaatccacctacgctgtatgagctngagaaaataacatttacattaaagtacaccaaggt

SEQ ID NO: 45758 - DNA, 71 bp, chicken (Gallus Gallus)
  misc_feature (36): n=a or g
cagctacttgaaggaccaaacagattctctcaactntgtactgcctacagccctattggaaatgcttacgt

SEQ ID NO: 45759 - DNA, 71 bp, chicken (Gallus Gallus)
  misc_feature (36): n=a or g
aaggcttttcgttcaagatcagaaacacaagtaacntgaagtactcttactttctctcactagcttgaaac

SEQ ID NO: 45760 - DNA, 71 bp, chicken (Gallus Gallus)
  misc_feature (36): n=a or g
tttagagacaagaacttctggatttttaaatcccanagttccgcagaggaatattttaaggtcattattta

SEQ ID NO: 45761 - DNA, 71 bp, chicken (Gallus Gallus)
  misc_feature (36): n=c or t
tgacaaaaacaaatctagaacttccacttgaaaaangttgaaaatgcaagcaactggtatgcagcctcatt

SEQ ID NO: 45762 - DNA, 71 bp, chicken (Gallus Gallus)
  misc_feature (36): n=c or t
aaatgcattcttaaaagctgagacaacaattaaagnaactctttcttcttaataagactacattcaccttc

SEQ ID NO: 45763 - DNA, 71 bp, chicken (Gallus Gallus)
  misc_feature (36): n=a or g
ctctcctaacaaccatgcttaaactagcccaatacnctctgtggtgtcacatacagaaacacatcttcagc

SEQ ID NO: 45764 - DNA, 71 bp, chicken (Gallus Gallus)
  misc_feature (36): n=a or c
ctgcagtctcctggaatatactaaaaaattaacttntctttgcagagctgttttagcagcagactgccatt

SEQ ID NO: 45765 - DNA, 71 bp, chicken (Gallus Gallus)
  misc_feature (36): n=a or c
caccctcagtcctcttggttatttttctccccacanatttgtttaatgttggatttaaaatgaagtctctt

SEQ ID NO: 45766 - DNA, 71 bp, chicken (Gallus Gallus)
  misc_feature (36): n=c or t
tcaaaactgagcctaagtttaccaggacggaattcnctaccagaattttcagattcttcatggccaccttc

SEQ ID NO: 45767 - DNA, 71 bp, chicken (Gallus Gallus)
  misc_feature (36): n=a or g
cacaagtgagatgattctccgatatcataaaaactnttagctataatggttacagtaattacacgagtagg

SEQ ID NO: 45768 - DNA, 71 bp, chicken (Gallus Gallus)
  misc_feature (36): n=a or c
attattattcaaagtatcagtgtggagtctgcagtnatgtgattacttttcctatatgcttgcatagtttt

SEQ ID NO: 45769 - DNA, 71 bp, chicken (Gallus Gallus)
  misc_feature (36): n=a or g
tcctatagacaaggttaagacttaaaggtctccacnccatctttagcacaggtttctgtttcatattatgt

SEQ ID NO: 45770 - DNA, 71 bp, chicken (Gallus Gallus)
  misc_feature (36): n=a or g
tgaggtgagggtcacttggacagagaagcaagaatncacgcataaaaaagtcagaacagatctgaactaat

SEQ ID NO: 45771 - DNA, 71 bp, chicken (Gallus Gallus)
  misc_feature (36): n=c or t
agacttgttctttgtaagtgactttcatctgcaaantgacttatgtattataatagtttcaggtactagac

SEQ ID NO: 45772 - DNA, 71 bp, chicken (Gallus Gallus)
  misc_feature (36): n=c or t
tcccctgaagtagcagctggaggtcaggcaaggatncctgcatttagctacctaaattgatctactgttca

SEQ ID NO: 45773 - DNA, 71 bp, chicken (Gallus Gallus)
  misc_feature (36): n=a or g
tgatgtattaactttttacagtgtcagtcgtaaacntgcgctcggtggcaacaaagtcgtcactacagttt

SEQ ID NO: 45774 - DNA, 71 bp, chicken (Gallus Gallus)
  misc_feature (36): n=g or t
tgaatacctcatgttacgcaagagcatgaattgacntaagcatccggataagagaggatacaataagcaaa

SEQ ID NO: 45775 - DNA, 71 bp, chicken (Gallus Gallus)
  misc_feature (36): n=c or t
atctagaaattcagattactgctatgaggtgtccangtaggaaagtccagtttgccttacagcacaactaa

SEQ ID NO: 45776 - DNA, 71 bp, chicken (Gallus Gallus)
  misc_feature (36): n=a or c
ctttaaaatgtagtgccagtagtcaaaaaccttttntattatgcagtgtttgtggtaaacttgtaacgtgt

SEQ ID NO: 45777 - DNA, 71 bp, chicken (Gallus Gallus)
  misc_feature (36): n=g or t
aagctgctttgttcccagttgtgctggtaagaatgngtgggaaaggcacctcatctcatgcaggtgtgcag

SEQ ID NO: 45778 - DNA, 71 bp, chicken (Gallus Gallus)
  misc_feature (36): n=a or g
tcacacctatttttgaacagttctttggcagtcatntctattgatacgtattagcacttgagctgtgcaga

SEQ ID NO: 45779 - DNA, 71 bp, chicken (Gallus Gallus)
  misc_feature (36): n=c or t
gaaagggttaacaactgtaggttttccatgttcccntacccacctgggtctgtggccttgtttgacagttt

SEQ ID NO: 45780 - DNA, 71 bp, chicken (Gallus Gallus)
  misc_feature (36): n=c or t
aatgaagttactgcagtgtgaaattttatgctgtcngagtctgaaatgatccagcttgtcctgttgggctt

SEQ ID NO: 45781 - DNA, 71 bp, chicken (Gallus Gallus)
  misc_feature (36): n=a or g
ttcctccagtggttggggaaaatcacggcctctgcnggatggatgcttctcttattttaaatgtaactttt

SEQ ID NO: 45782 - DNA, 71 bp, chicken (Gallus Gallus)
  misc_feature (36): n=c or t
agagcttccccagagccatgcaagtggtgcactgtnttggtgtagagatgtgcaccatcccatggtacaga

SEQ ID NO: 45783 - DNA, 71 bp, chicken (Gallus Gallus)
  misc_feature (36): n=c or t
gggatgaaatagtttcctataatgaaatggtttgtngataggtctgcgaagagttgatgtcagcaaagcca

SEQ ID NO: 45784 - DNA, 71 bp, chicken (Gallus Gallus)
  misc_feature (36): n=c or t
caccatcagaaggcaaatcagtctgcaccggaggtngcagagcaaccacccctgagctattggcgtgtggc

SEQ ID NO: 45785 - DNA, 71 bp, chicken (Gallus Gallus)
  misc_feature (36): n=c or t
agggtgagctcagcagcatgcattcatgtgcacatngctgtccccaaccctgcaatagcaccggtgttccc

SEQ ID NO: 45786 - DNA, 71 bp, chicken (Gallus Gallus)
  misc_feature (36): n=a or g
ataccctagttcctgtactgtaagctgcagtgagcngatacataggttattctctattgatgtttgaatta

SEQ ID NO: 45787 - DNA, 71 bp, chicken (Gallus Gallus)
  misc_feature (36): n=g or t
aattctgttgaaactttgttgaagtcttgactcttnttatatattcagcataatctaattattattggtct

SEQ ID NO: 45788 - DNA, 71 bp, chicken (Gallus Gallus)
  misc_feature (36): n=a or g
atctgaaatgtggtagcaggaaacaaagctgaaagngttttggaagaatgaaatgtgatttggtgtgttct

SEQ ID NO: 45789 - DNA, 71 bp, chicken (Gallus Gallus)
  misc_feature (36): n=c or t
taattccagtgaatcaaaaagagagctttcagtgangaccatttctaacttacttcagttttttctttcct

SEQ ID NO: 45790 - DNA, 71 bp, chicken (Gallus Gallus)
  misc_feature (36): n=a or g
tcctctggtaactgctattaccttcactgtgacacntaactgttccagtcatctgaatagaaccaagtttt

SEQ ID NO: 45791 - DNA, 71 bp, chicken (Gallus Gallus)
  misc_feature (36): n=a or g
aagtgctgagtggtataaagcaaagctgacaatccntgctaatccaaatacttcacttgtgggattttcat

SEQ ID NO: 45792 - DNA, 71 bp, chicken (Gallus Gallus)
  misc_feature (36): n=a or g
acacccttctctctggtctcctaagcagcttccagngcccttaatgtacacaaagtgttctcatggatgct

SEQ ID NO: 45793 - DNA, 71 bp, chicken (Gallus Gallus)
  misc_feature (36): n=g or t
tgacagcacgctgaggtcattccctgtggtcggtanaacctgggctatggaaatattaagcctcactttct

SEQ ID NO: 45794 - DNA, 71 bp, chicken (Gallus Gallus)
  misc_feature (36): n=c or t
aggttcaagttgctgccagttctatttgtcttagcntttatacttacttttgtgtcattaatttcatcaaa

SEQ ID NO: 45795 - DNA, 71 bp, chicken (Gallus Gallus)
  misc_feature (36): n=c or t
tgcctttttcctcctggccacgtcagcctctgagcngtttttccctcaagcaatcccactcacctcaccgc

SEQ ID NO: 45796 - DNA, 71 bp, chicken (Gallus Gallus)
  misc_feature (36): n=c or t
aaaacatgtttgtattacttcccagctaaaccatgnctgggacactgtagagtgtgtaattatttatctta

SEQ ID NO: 45797 - DNA, 71 bp, chicken (Gallus Gallus)
  misc_feature (36): n=a or g
gcgccatgggtgagttgggtttccgcggggcctgcntgtcatccgccgccatccgttcgctgtgctgccgc

SEQ ID NO: 45798 - DNA, 71 bp, chicken (Gallus Gallus)
  misc_feature (36): n=c or t
cccctcctcaatactgttttctcccctagcacctangcaatttttccagtcatatttgttgtgcagcaagt

SEQ ID NO: 45799 - DNA, 71 bp, chicken (Gallus Gallus)
  misc_feature (36): n=a or c
ttaaatgtacaaaaaataacaaaatcagatctaagnaagctttttagatcccaggttgcaatgcagaattt

SEQ ID NO: 45800 - DNA, 71 bp, chicken (Gallus Gallus)
  misc_feature (36): n=c or t
aattccccctattttgaaataggtttgttttacagntgtttggacaaaaccatttcaacattgctttgata

SEQ ID NO: 45801 - DNA, 71 bp, chicken (Gallus Gallus)
  misc_feature (36): n=c or t
aagtatgaagatacttcctttctacttgctgttccngaaactgtcatcaatatcatttctaacccgggttt

SEQ ID NO: 45802 - DNA, 71 bp, chicken (Gallus Gallus)
  misc_feature (36): n=c or t
tcccagttaggcttttaatcaattttttcacaggtntatgtgatttaagagccagtgagccctacatgtga

SEQ ID NO: 45803 - DNA, 71 bp, chicken (Gallus Gallus)
  misc_feature (36): n=c or t
gttctcattgaagatgtgcagctacacaaaaaccangtggatgttctgtaattttccatattaaacatttg

SEQ ID NO: 45804 - DNA, 71 bp, chicken (Gallus Gallus)
  misc_feature (36): n=c or t
aaacagtccaagcttctctggagctgcttgttacanagcattcagtcctgggatgcctggagttcccctcc

SEQ ID NO: 45805 - DNA, 71 bp, chicken (Gallus Gallus)
  misc_feature (36): n=c or t
catgagtggtgtgattttttgcacttaatgtagcantgaggggaaatttggccctgaacgtcagtattgtg

SEQ ID NO: 45806 - DNA, 71 bp, chicken (Gallus Gallus)
  misc_feature (36): n=a or g
ttcttttctgagttgttaaatatttgttaatgaacnagcccaaagagaggagtgctagagcagaacttcag

SEQ ID NO: 45807 - DNA, 71 bp, chicken (Gallus Gallus)
  misc_feature (36): n=a or g
caaaacaaggaaaatgccaatgctgtgatccccacnattaattgtctctataacagatggtaaagtcaccc

SEQ ID NO: 45808 - DNA, 71 bp, chicken (Gallus Gallus)
  misc_feature (36): n=a or c
tctaaaagcactctaagcacacttgctactactctntattatgagatagaagatatcccaccaacttctag

SEQ ID NO: 45809 - DNA, 71 bp, chicken (Gallus Gallus)
  misc_feature (36): n=c or t
tacaggagaagcctgggcatcttggcatttttcagnaccaaactcactgatttaacaaagctgagaagtca

SEQ ID NO: 45810 - DNA, 71 bp, chicken (Gallus Gallus)
  misc_feature (36): n=a or c
acctcaccaatcccccccataagatacctcggctcntccttcgctccaagaacggcattcatttgtactta

SEQ ID NO: 45811 - DNA, 71 bp, chicken (Gallus Gallus)
  misc_feature (36): n=c or t
tacaactagctgagctaacaacttagtctgagaaanacaccagactcatattcagcttggatacaatcaag

SEQ ID NO: 45812 - DNA, 71 bp, chicken (Gallus Gallus)
  misc_feature (36): n=a or c
aggaaccggagagctcctcagtcccatccccatagngtgtcccagggtgactgaggtgctgagaaagtgtg

SEQ ID NO: 45813 - DNA, 71 bp, chicken (Gallus Gallus)
  misc_feature (36): n=c or t
agcctaattctaacttgttcttcagcaaaaaaatangtgatccaccttgccctcatgatgactgcgaacca

SEQ ID NO: 45814 - DNA, 71 bp, chicken (Gallus Gallus)
  misc_feature (36): n=c or t
tctctctttcctcattgtccattgtgttatttttanttcactcatgctgaagctaaaggtcatccttgtgt

SEQ ID NO: 45815 - DNA, 71 bp, chicken (Gallus Gallus)
  misc_feature (36): n=a or g
agtagtttctcatgagttcatagtagtgcaccttgnctgtgggctgcttattgagatggactttgtaccac

SEQ ID NO: 45816 - DNA, 71 bp, chicken (Gallus Gallus)
  misc_feature (36): n=a or g
ctgtgaaggattgctaaataaactgtggggtagcantgaaaacacacagcctttggattttcagcggaaaa

SEQ ID NO: 45817 - DNA, 71 bp, chicken (Gallus Gallus)
  misc_feature (36): n=a or g
ttggtcattcttgaactgcaaaacacatttgataantaagttgagagataatgctaagaaaaggtgaaagc

SEQ ID NO: 45818 - DNA, 71 bp, chicken (Gallus Gallus)
  misc_feature (36): n=a or g
ttgtactcttaccaagacacctccagtaacttgcantctgagctgcttgagccttagaaagctcctccatc

SEQ ID NO: 45819 - DNA, 71 bp, chicken (Gallus Gallus)
  misc_feature (36): n=c or t
cactgtgctgatctagaactgcatccaggggatgtntccacaggccctggtgtacaacagggggtttcagt

SEQ ID NO: 45820 - DNA, 71 bp, chicken (Gallus Gallus)
  misc_feature (36): n=c or t
acaggcaaatcagaagcatgtatatctaaacttcangactgcatgccttttcttgagactctcaaaacaaa

SEQ ID NO: 45821 - DNA, 71 bp, chicken (Gallus Gallus)
  misc_feature (36): n=c or t
agaaaataaggttattcaagccatgtgagtaggatngaaaatgattcatcaaggctgaaaaatggctaacc

SEQ ID NO: 45822 - DNA, 71 bp, chicken (Gallus Gallus)
  misc_feature (36): n=c or t
ctccaggcattatttgctgcatgccatcaagtcccngctcttagacagaactattcctcttctcctggact

SEQ ID NO: 45823 - DNA, 71 bp, chicken (Gallus Gallus)
  misc_feature (36): n=c or t
tgcttctcaaagggaaacactcaaaatataccctgngtgcaccatgcttcatccaacccatccagttgctc

SEQ ID NO: 45824 - DNA, 71 bp, chicken (Gallus Gallus)
  misc_feature (36): n=c or t
gtacataccaaacagaaagtccccaaatgccctgancaaacaggatttaaaccttctacccaggatcactg

SEQ ID NO: 45825 - DNA, 71 bp, chicken (Gallus Gallus)
  misc_feature (36): n=c or t
acaaatcaactctacacctgctgttgtcggagaagncagagtcttcattagtgcacatttcatcatttggg

SEQ ID NO: 45826 - DNA, 71 bp, chicken (Gallus Gallus)
  misc_feature (36): n=a or g
gtcgctgagtgctgtcacattcattgcagttggatngatcaaaagggtgggaagctggctgggctaggagg

SEQ ID NO: 45827 - DNA, 71 bp, chicken (Gallus Gallus)
  misc_feature (36): n=c or t
acaaggaaacaatctctgctgtcctcaaaccaaaanccacagctgactgatttccagtccctccactgtat

SEQ ID NO: 45828 - DNA, 71 bp, chicken (Gallus Gallus)
  misc_feature (36): n=a or c
atgctgttcggtgtctgaattggacttattaccctnctattaaccgaaagccaaaaatctactcaagattt

SEQ ID NO: 45829 - DNA, 71 bp, chicken (Gallus Gallus)
  misc_feature (36): n=a or g
catttctaaccctacaaacatatttctagccctcanagaaagcagatcataaattggtaaataggctttcc

SEQ ID NO: 45830 - DNA, 71 bp, chicken (Gallus Gallus)
  misc_feature (36): n=a or g
ttatccattcagcacagatgtttggaagactatcancctttcaaagacaaaggattgatggtgacaagccc

SEQ ID NO: 45831 - DNA, 71 bp, chicken (Gallus Gallus)
  misc_feature (36): n=c or t
agaattcagaaatgagtcagttcttggatttgttangaacacctggatccgagagactcacttcctactga

SEQ ID NO: 45832 - DNA, 71 bp, chicken (Gallus Gallus)
  misc_feature (36): n=c or t
tctgcatttaaagagtgcaagcattgtagggatctncattcagagacagaaaaacttatgcctggcttgaa

SEQ ID NO: 45833 - DNA, 71 bp, chicken (Gallus Gallus)
  misc_feature (36): n=a or g
cacacactgaaatcagtggcaataccaaagagacantatcttgcttaacataaaatttgcctttcctccaa

SEQ ID NO: 45834 - DNA, 71 bp, chicken (Gallus Gallus)
  misc_feature (36): n=c or t
catacaggtgcaaactgaaaattggcagaaactttntcattctgtgcttctatctctggtgaattacagga

SEQ ID NO: 45835 - DNA, 71 bp, chicken (Gallus Gallus)
  misc_feature (36): n=a or g
ggaaagcctacttcctagcacatcaaccacagttcngacctgtatgcaatatgcatcaaatgagtaatttt

SEQ ID NO: 45836 - DNA, 71 bp, chicken (Gallus Gallus)
  misc_feature (36): n=a or c
gaacataacagagtcctggagatgcagataacaagnattaatttgatatagtattggatgtatgcactcat

SEQ ID NO: 45837 - DNA, 71 bp, chicken (Gallus Gallus)
  misc_feature (36): n=g or t
acactcccccagtctccacatttgctgagcctttanaagtgtcaccatcctgctctggatcagcagtgctt

SEQ ID NO: 45838 - DNA, 71 bp, chicken (Gallus Gallus)
  misc_feature (36): n=c or t
aaaatgtgggttttgtgcattattagtactagctancttagaagtgtcctgtaactttatgcaaattggca

SEQ ID NO: 45839 - DNA, 71 bp, chicken (Gallus Gallus)
  misc_feature (36): n=c or t
aaaagtatctggggaaataatacatgataccttaangaacatctgaaaacttaaaggccatcagaaaatag

SEQ ID NO: 45840 - DNA, 71 bp, chicken (Gallus Gallus)
  misc_feature (36): n=c or t
agatgattagtcctacaatcttgtctgatctattcntttgcctctaggaaaagggtttcttgaggatacag

SEQ ID NO: 45841 - DNA, 71 bp, chicken (Gallus Gallus)
  misc_feature (36): n=c or t
gacacattctggagtccatttcagtgctgagacttngctctcatgtcactgcactgtgttctcctctaaag

SEQ ID NO: 45842 - DNA, 71 bp, chicken (Gallus Gallus)
  misc_feature (36): n=g or t
agaatcttgactttgacattgtaatcgagaattagncaagacaagcaagcacgattttcaggacacaataa

SEQ ID NO: 45843 - DNA, 71 bp, chicken (Gallus Gallus)
  misc_feature (36): n=a or c
atattgcttcagggcaaacaaattctcaagactacntaaaaatacaacttttgtagtgtgaggcttcttgc

SEQ ID NO: 45844 - DNA, 71 bp, chicken (Gallus Gallus)
  misc_feature (36): n=c or t
atctcactgcagtgtgcctgcatactggttaagtgngcttctcttacaggtcgtaaatagggctgtgattg

SEQ ID NO: 45845 - DNA, 71 bp, chicken (Gallus Gallus)
  misc_feature (36): n=c or t
ttcgacaggtcactagaagaaaataccagttcttanagctaagatggcgcattatcagattctgttagtat

SEQ ID NO: 45846 - DNA, 71 bp, chicken (Gallus Gallus)
  misc_feature (36): n=a or c
accttgagagccagctccacgtgagcagcattagtnacatgcagcaaaacatttctggtgggaaaaaagaa

SEQ ID NO: 45847 - DNA, 71 bp, chicken (Gallus Gallus)
  misc_feature (36): n=c or t
aaatgtagcaatgagtttctaaagctgtgttaatcnaaaactataaacgaaataaggagcatcagacagga

SEQ ID NO: 45848 - DNA, 71 bp, chicken (Gallus Gallus)
  misc_feature (36): n=c or t
ctttagctaccggaagtgcagggaggcagaacatcntgaacaaagaacttcaaagaggacaaatgtatctg

SEQ ID NO: 45849 - DNA, 71 bp, chicken (Gallus Gallus)
  misc_feature (36): n=g or t
aataaacatacagaaagaagcaaaggtaaggacaancatatttctctcttttggtagatctattagctgct

SEQ ID NO: 45850 - DNA, 71 bp, chicken (Gallus Gallus)
  misc_feature (36): n=a or g
tttaacctgctagtattcacctatcttgaaatccangattttagacttcgggacttctgtcagtagctgaa

SEQ ID NO: 45851 - DNA, 71 bp, chicken (Gallus Gallus)
  misc_feature (36): n=a or g
gcactttggaacctcactgacgaatcaccaacaacntgtcggcacttcattgaaaatcaaggtcttgaact

SEQ ID NO: 45852 - DNA, 71 bp, chicken (Gallus Gallus)
  misc_feature (36): n=c or t
tattttaaactcattacagctgccaggtactgcagnatgttaattgaagagggtggcttacagcacttgta

SEQ ID NO: 45853 - DNA, 71 bp, chicken (Gallus Gallus)
  misc_feature (36): n=c or t
agtgtcagcacacagcactggagccttgaggaatgncagtgtttctgtagagtcttgtttaaattgggtaa

SEQ ID NO: 45854 - DNA, 71 bp, chicken (Gallus Gallus)
  misc_feature (36): n=c or t
gttatgtcatgacagtgacttagttctttctgaggngctgtcagaccttcttaatcagatatgggtccact

SEQ ID NO: 45855 - DNA, 71 bp, chicken (Gallus Gallus)
  misc_feature (36): n=c or t
tccataaccactctggccagccactcttttgttttngaatgcaaaagaaacagtgaggagaaattggtata

SEQ ID NO: 45856 - DNA, 71 bp, chicken (Gallus Gallus)
  misc_feature (36): n=a or g
caaaagaaattcactggatgtgtgaataaacagaanggacaaggaattgaaaaatctgattacctctgtga

SEQ ID NO: 45857 - DNA, 71 bp, chicken (Gallus Gallus)
  misc_feature (36): n=a or g
ttgctaaagacagtggcatcttaaaggtgttaatcntgatggaaaatcttgccctctgtcttcaaataaca

SEQ ID NO: 45858 - DNA, 71 bp, chicken (Gallus Gallus)
  misc_feature (36): n=c or t
agcaagccaacaattattttaaagatcaggaaatcngaatttcagaacacaagcaggaggagaatggaaaa

SEQ ID NO: 45859 - DNA, 71 bp, chicken (Gallus Gallus)
  misc_feature (36): n=c or t
ttcagttcatcttaatttattgcttatttcaataangtgcttctttctgacctgtgtataaacaggctgct

SEQ ID NO: 45860 - DNA, 71 bp, chicken (Gallus Gallus)
  misc_feature (36): n=c or t
tctcaccaacacacacaggaatgttatagggcagantgagatgcggcacaaaactaaagagcataacccca

SEQ ID NO: 45861 - DNA, 71 bp, chicken (Gallus Gallus)
  misc_feature (36): n=c or t
actgaggccacaggaagacatgcaagcaaacaagcnctgcctctgcaccactctgcccagtgctcccagtt

SEQ ID NO: 45862 - DNA, 71 bp, chicken (Gallus Gallus)
  misc_feature (36): n=c or t
ccctgggaaggatgtagttttagcccaagagaaganacacacaatcataaactccaacctgtgaagttctg

SEQ ID NO: 45863 - DNA, 71 bp, chicken (Gallus Gallus)
  misc_feature (36): n=g or t
agaagtccatacaatgacacctgaataacagaaatngaatgaaatttcacagcatacagtgtgtgtatgag

SEQ ID NO: 45864 - DNA, 71 bp, chicken (Gallus Gallus)
  misc_feature (36): n=a or g
ataatccggttttgcagtgagcactactagaggtcnggaggaaaagcaataatatgaaatgtaaagctggg

SEQ ID NO: 45865 - DNA, 71 bp, chicken (Gallus Gallus)
  misc_feature (36): n=a or g
caatctaaaatcaacaacagttttttgtaccctgantttctccaagccttctttagaagcttagctgcaca

SEQ ID NO: 45866 - DNA, 71 bp, chicken (Gallus Gallus)
  misc_feature (36): n=a or g
ttcactcacactgtcagcctgtctgttgcagaagcncaaatgctccctaggattcatgtgaagcagtaagc

SEQ ID NO: 45867 - DNA, 71 bp, chicken (Gallus Gallus)
  misc_feature (36): n=a or g
ccagagcggggtgggtgtgctggagacagaaactgncagatgggagtggtgcctgaggataatacatcaga

SEQ ID NO: 45868 - DNA, 71 bp, chicken (Gallus Gallus)
  misc_feature (36): n=c or t
agagaagaggtgagcccaccgcccagcttgctttgnaggaaggtttgccaaaccctcacctgggactcagt

SEQ ID NO: 45869 - DNA, 71 bp, chicken (Gallus Gallus)
  misc_feature (36): n=c or t
ttctgattgagccatttaacacataaaactataacncataagttcaagcaagaactctttcctttctgttc

SEQ ID NO: 45870 - DNA, 71 bp, chicken (Gallus Gallus)
  misc_feature (36): n=g or t
aagaagttgagaggcatgatttagtccaaaccccanattaatactatacaaggcacattgtttagtcacaa

SEQ ID NO: 45871 - DNA, 71 bp, chicken (Gallus Gallus)
  misc_feature (36): n=c or t
ccctgcataaaatataaagaactgatttatctcccncaagagcaagggctacaaaatctgctcctcatctt

SEQ ID NO: 45872 - DNA, 71 bp, chicken (Gallus Gallus)
  misc_feature (36): n=c or t
ctgggaactgcctttgcagtattttcccagcagtangtcttccaatggacagctctacagaaagctcaggg

SEQ ID NO: 45873 - DNA, 71 bp, chicken (Gallus Gallus)
  misc_feature (36): n=g or t
ttccagatttcacaccagcttcgcttttgtgctccngctgaaaacacagctttattgcatgagcataagta

SEQ ID NO: 45874 - DNA, 71 bp, chicken (Gallus Gallus)
  misc_feature (36): n=g or t
attgaccaccaacttgcttaagttttcctgggtttnttcacacagtcataagtctgagagatcagaggggc

SEQ ID NO: 45875 - DNA, 71 bp, chicken (Gallus Gallus)
  misc_feature (36): n=c or t
cagcagtgcatcactgaggttcagagcctcagtgcntagctcagggcagagaccctgaaggtgaagttatc

SEQ ID NO: 45876 - DNA, 71 bp, chicken (Gallus Gallus)
  misc_feature (36): n=c or t
tggagctgtgctctggcagggaagtccccctggtcnggcctggtgtcatagagtgctcagaatgaatggtg

SEQ ID NO: 45877 - DNA, 71 bp, chicken (Gallus Gallus)
  misc_feature (36): n=c or t
caccaaaattctctaattcatgattcctgacattangtgacaccacaaatgtaagatttgtcctgcactga

SEQ ID NO: 45878 - DNA, 71 bp, chicken (Gallus Gallus)
  misc_feature (36): n=c or t
ttgaacaacagtcactagccacacttcagcatcacntcacttggttttagtgttcattttcaagaaagtac

SEQ ID NO: 45879 - DNA, 71 bp, chicken (Gallus Gallus)
  misc_feature (36): n=a or g
ttgttgaaaaggcatgagagaaaatgttcaagtggncagattgcctgttgtgaatatgaaatttgctttaa

SEQ ID NO: 45880 - DNA, 71 bp, chicken (Gallus Gallus)
  misc_feature (36): n=a or c
ctcatctccaactcacctccatgagatttcaagatnatgcacaccccaactcactttcaaactagaaactc

SEQ ID NO: 45881 - DNA, 71 bp, chicken (Gallus Gallus)
  misc_feature (36): n=c or t
tcatgtttccctgtaacaagtaatgcaattatactncaagatttgatataaatttgaaagtaagtttgaga

SEQ ID NO: 45882 - DNA, 71 bp, chicken (Gallus Gallus)
  misc_feature (36): n=a or g
aagacctcacactccagcccttccatctccctaacnaacacccagacacagaggacaaaatgttgcccagg

SEQ ID NO: 45883 - DNA, 71 bp, chicken (Gallus Gallus)
  misc_feature (36): n=a or g
ttatttgttttttaaactaaaagctgagaggaaagncttaagcccactttagtcagttgagctaagatagc

SEQ ID NO: 45884 - DNA, 71 bp, chicken (Gallus Gallus)
  misc_feature (36): n=g or t
aattctcaggaagagacagcgaaagaggatccacantgcatatgtaggagattgagggttggtctttgctc

SEQ ID NO: 45885 - DNA, 71 bp, chicken (Gallus Gallus)
  misc_feature (36): n=a or g
agttggagtaattgtccatttgccttgtagcagacnactttggttctgaatttggaataacttgttcaaaa

SEQ ID NO: 45886 - DNA, 71 bp, chicken (Gallus Gallus)
  misc_feature (36): n=a or g
gctttcaatgcaatgaaagactagaagttttggggnaggttgtcgagaatgtgttggggcaatggtcaatt

SEQ ID NO: 45887 - DNA, 71 bp, chicken (Gallus Gallus)
  misc_feature (36): n=g or t
gtgtggagaagaaagggtgcagctctataccctccnaattccttaggttttccagcgtgagaattgtgtct

SEQ ID NO: 45888 - DNA, 71 bp, chicken (Gallus Gallus)
  misc_feature (36): n=a or g
cctcaatcacaataccatttactctttaaagctaanccaagtctgtaccctattggtctattcccagtcct

SEQ ID NO: 45889 - DNA, 71 bp, chicken (Gallus Gallus)
  misc_feature (36): n=a or g
taaaccataaggaccgtgagggaagcttacatgctnaagtgtccttaaatgttctatagcttccacttcaa

SEQ ID NO: 45890 - DNA, 71 bp, chicken (Gallus Gallus)
  misc_feature (36): n=a or g
ctggaacagggcagtttcttgcttagcttgaactcnttgctgatggatgctcggtaaaaggtcttggagac

SEQ ID NO: 45891 - DNA, 71 bp, chicken (Gallus Gallus)
  misc_feature (36): n=c or t
ggcttattaatttgcaatgttgcagaagtatagttnagtttcagatccaactcagagagagccataagagt

SEQ ID NO: 45892 - DNA, 71 bp, chicken (Gallus Gallus)
  misc_feature (36): n=a or g
cccagcttggtgtgactgagctccagaaagcaaggnacacaaaacatctccacttacaaatagcctctgca

SEQ ID NO: 45893 - DNA, 71 bp, chicken (Gallus Gallus)
  misc_feature (36): n=c or t
cgttttgtctttctgtacatctctcccaaaatgctnttcattctgtgctgtctgtgaggatggggaccttg

SEQ ID NO: 45894 - DNA, 71 bp, chicken (Gallus Gallus)
  misc_feature (36): n=a or g
caagtttcattaaatgttagaattatactaataganaagcagtgcttaaagaagctgaatagaagtgctgt

SEQ ID NO: 45895 - DNA, 71 bp, chicken (Gallus Gallus)
  misc_feature (36): n=a or g
agatagggccactttacaaccttcactttttgcgcnaactgaaaggcctcattgttagcgcaggggatgtg

SEQ ID NO: 45896 - DNA, 71 bp, chicken (Gallus Gallus)
  misc_feature (36): n=g or t
aatcatcatttcttgtcaagaaagacataattcagntgccgatacattcccagttttacagagcattttct

SEQ ID NO: 45897 - DNA, 71 bp, chicken (Gallus Gallus)
  misc_feature (36): n=a or g
ctttctaaaattaattaaaccttctctgctttgtanagtgagaatttgttttaggtagaacagatgaaaca

SEQ ID NO: 45898 - DNA, 71 bp, chicken (Gallus Gallus)
  misc_feature (36): n=a or g
ggcttaaaaaaatttgtcatacatgctgctgttgangttataagcttgtctttacacttacaaagagcatg

SEQ ID NO: 45899 - DNA, 71 bp, chicken (Gallus Gallus)
  misc_feature (36): n=c or t
aaggaccagatgtaactataggggcctataaaatgnaatacaaatattatccacttccttaaaataaatct

SEQ ID NO: 45900 - DNA, 71 bp, chicken (Gallus Gallus)
  misc_feature (36): n=a or g
gggtcttccacatttcctattttacaatcaaattcnataaaatcacccggtctggaatacagcttgctttc

SEQ ID NO: 45901 - DNA, 71 bp, chicken (Gallus Gallus)
  misc_feature (36): n=g or t
gcagttgtggtttgaggaacacaccattaaaatcanctgctcctgaagtggcagaagggcggaagttgaca

SEQ ID NO: 45902 - DNA, 71 bp, chicken (Gallus Gallus)
  misc_feature (36): n=c or t
actaacatttggcagcactaatctcagaaataacantcaaaacaactcaagaaaaaggctgaccagtgcaa

SEQ ID NO: 45903 - DNA, 71 bp, chicken (Gallus Gallus)
  misc_feature (36): n=a or g
ggaaaatcaagttgtatgagttgccatcattcatancattcatccatcctcaggcatgcaagaagtatatt

SEQ ID NO: 45904 - DNA, 71 bp, chicken (Gallus Gallus)
  misc_feature (36): n=g or t
caacgtacatagactgcctccctgcccatcctccangaggacattgtaagatttagaatgagccaaaaatg

SEQ ID NO: 45905 - DNA, 71 bp, chicken (Gallus Gallus)
  misc_feature (36): n=g or t
gctggtactgtcagaacaacgagctcgtgcatcttncaggctttctggcaatttgaagggcgggcagccta

SEQ ID NO: 45906 - DNA, 71 bp, chicken (Gallus Gallus)
  misc_feature (36): n=a or c
tggctcttgcccttcatttgtgatgctgctcacttntgggactctcctctcagcccagcacatcagaggct

SEQ ID NO: 45907 - DNA, 71 bp, chicken (Gallus Gallus)
  misc_feature (36): n=c or t
ctcaatttcctttcatattccagctgaacaaagcanttggtcacattgctcttgtttttaggagctgtcct

SEQ ID NO: 45908 - DNA, 71 bp, chicken (Gallus Gallus)
  misc_feature (36): n=c or t
aaggggaggaaatgggatgcagaagtcctggatcangttaggagagcgtaggtaacccagaaggctgtagg

SEQ ID NO: 45909 - DNA, 71 bp, chicken (Gallus Gallus)
  misc_feature (36): n=a or g
tgtgcttacagcctgcacacaaaatcagctttctangtatctcagagggctgatccatgagatcggactgc

SEQ ID NO: 45910 - DNA, 71 bp, chicken (Gallus Gallus)
  misc_feature (36): n=c or t
agtagtttccctgtcctctggtaccaagcatacaanccacacctcctcacctcctcacctccccactccag

SEQ ID NO: 45911 - DNA, 71 bp, chicken (Gallus Gallus)
  misc_feature (36): n=c or t
taacgccggagagaatgaaggcatccccctcttctncttaaattcatcagagctcgaaggcagcatttgtt

SEQ ID NO: 45912 - DNA, 71 bp, chicken (Gallus Gallus)
  misc_feature (36): n=a or g
cctgcactgcttcatgaaagaaaggcgtgggcctgnggcactcagaagcattccattcattgcctttgttt

SEQ ID NO: 45913 - DNA, 71 bp, chicken (Gallus Gallus)
  misc_feature (36): n=c or t
gcgccaaacaaagaaaccactttggtttgggctttngtttcctgtttgtacaaaccattgatgtctttgta

SEQ ID NO: 45914 - DNA, 71 bp, chicken (Gallus Gallus)
  misc_feature (36): n=a or g
gaacatgaaattaaagccccctaaaggtacaataanatagcagatcaaaacatgagccggttggaaacctg

SEQ ID NO: 45915 - DNA, 71 bp, chicken (Gallus Gallus)
  misc_feature (36): n=a or c
cactaaaatagctcgtttttttcatactttgattcntccacagtttacactatcctttcaaattaacactg

SEQ ID NO: 45916 - DNA, 71 bp, chicken (Gallus Gallus)
  misc_feature (36): n=a or g
cctctaattgcccccgttcccacgcagctaacactngcatttattgatcagtctcgcttcctcccagcatc

SEQ ID NO: 45917 - DNA, 71 bp, chicken (Gallus Gallus)
  misc_feature (36): n=c or t
ctggagcgggtggagcctctccagaacccctgcccnggctcaaggagtgacctcgttagggaagctgcagg

SEQ ID NO: 45918 - DNA, 71 bp, chicken (Gallus Gallus)
  misc_feature (36): n=a or g
agctttgcagccttgctgggacatagagcatggaantagcaatacttttgagatgaccaggggccaaagga

SEQ ID NO: 45919 - DNA, 71 bp, chicken (Gallus Gallus)
  misc_feature (36): n=a or g
gtgaaacaaacagatcttttacgtttcttttgcaanacttttagttcagagacagccgtcccagcttggct

SEQ ID NO: 45920 - DNA, 71 bp, chicken (Gallus Gallus)
  misc_feature (36): n=a or g
agtgcctgcccagcaaggcctctgcctctagcacanaggaaggttgtgatctagaacataagtgtccaact

SEQ ID NO: 45921 - DNA, 71 bp, chicken (Gallus Gallus)
  misc_feature (36): n=a or g
gatcggtgttagacaggagaaaggggcagagaatgnctgtcacccttcagctgttttgctttgtatggcta

SEQ ID NO: 45922 - DNA, 71 bp, chicken (Gallus Gallus)
  misc_feature (36): n=c or t
tgcagggaagcatgctcatccattattttatgtcantgaaattccattatagattgccacagtgcaactga

SEQ ID NO: 45923 - DNA, 71 bp, chicken (Gallus Gallus)
  misc_feature (36): n=a or g
cttatatcacagaggggtgaataggccaggtattcnaattctgtttaaaatatcctcttactttctccccc

SEQ ID NO: 45924 - DNA, 71 bp, chicken (Gallus Gallus)
  misc_feature (36): n=c or t
cagttctggtttgagacagaaatattcaaacagcangttcaaggagacctacaatgctcaatatttcctac

SEQ ID NO: 45925 - DNA, 71 bp, chicken (Gallus Gallus)
  misc_feature (36): n=c or t
ctcggcctcgggaggagctggactgagttttgacangcttaggaaagacggcgctctggaatcctgttttc

SEQ ID NO: 45926 - DNA, 71 bp, chicken (Gallus Gallus)
  misc_feature (36): n=c or t
gatatggaaacttggtttcaattaatctgagctgtnttcagtgtgtgcatgttacacaacactgctgtaag

SEQ ID NO: 45927 - DNA, 71 bp, chicken (Gallus Gallus)
  misc_feature (36): n=g or t
aacatttatcagagacaccaaacacattctggagangtttacttcacctgggacaaccacaacagcaacga

SEQ ID NO: 45928 - DNA, 71 bp, chicken (Gallus Gallus)
  misc_feature (36): n=c or t
cttggtatgtttgaaataggatttattcataagcanggccagaagagatgattctgagaaataaatgaaga

SEQ ID NO: 45929 - DNA, 71 bp, chicken (Gallus Gallus)
  misc_feature (36): n=c or t
atttgaaagtgcacaccatgttctttctcttagcanctctacgtgccagtgtacagttttgtcactatatc

SEQ ID NO: 45930 - DNA, 71 bp, chicken (Gallus Gallus)
  misc_feature (36): n=a or g
agttgggtcgtgtcaaaacgacgcaggaataatgcntttttaaaagctcctttttataccctgctagataa

SEQ ID NO: 45931 - DNA, 71 bp, chicken (Gallus Gallus)
  misc_feature (36): n=a or g
aggtcaagctgtgaaagtctgagttatcttttaccngctctgtgatgaaaggtaagataaaagcatcgcgg

SEQ ID NO: 45932 - DNA, 71 bp, chicken (Gallus Gallus)
  misc_feature (36): n=a or g
ggcatctttccaaaaaatattttcgtgtgaagtacntatgatttgtattttaaacgttctccttcactgag

SEQ ID NO: 45933 - DNA, 71 bp, chicken (Gallus Gallus)
  misc_feature (36): n=c or t
ctcattcccattcctccagcgaacgcacagtgccanagctcacatctagatgaggcgcagatatttaatga

SEQ ID NO: 45934 - DNA, 71 bp, chicken (Gallus Gallus)
  misc_feature (36): n=a or g
ttcagatacagctaacctgagagtttatgtgagctncaaggtgttaaaatgcaaccatctaaaaactcttg

SEQ ID NO: 45935 - DNA, 71 bp, chicken (Gallus Gallus)
  misc_feature (36): n=a or g
ctacattcctagtgtgggatatgtctgactcgtggnggttttgtgactccatactgctggctttgccctgg

SEQ ID NO: 45936 - DNA, 71 bp, chicken (Gallus Gallus)
  misc_feature (36): n=g or t
agattgggctgtgctgcctttaaccacagctcatancatcctttcaaagcaaactgagcacaccccagtag

SEQ ID NO: 45937 - DNA, 71 bp, chicken (Gallus Gallus)
  misc_feature (36): n=c or t
aatccatgtaaacagtcattaatatgccttggggtnctccttcaaaggagggaagccacccacccaagcag

SEQ ID NO: 45938 - DNA, 71 bp, chicken (Gallus Gallus)
  misc_feature (36): n=a or g
tttacattactacagtaaggcagtagctttactgtnggctttgtcacttcatgagctgtattgtaacaggc

SEQ ID NO: 45939 - DNA, 71 bp, chicken (Gallus Gallus)
  misc_feature (36): n=a or g
acttaaatgttcaaatattatttggattgcaatgtntaatgtctctcaaatagacaagaaaaatatgggca

SEQ ID NO: 45940 - DNA, 71 bp, chicken (Gallus Gallus)
  misc_feature (36): n=a or g
caggttcacagtgctatctataagagtcatcactancaacttttaattacctgtttttcggtaagaatcca

SEQ ID NO: 45941 - DNA, 71 bp, chicken (Gallus Gallus)
  misc_feature (36): n=a or g
aatcgcatgtaaatttttcaattagcacgctcgtcnaatatccaggcttctctacttccagcaagttctgt

SEQ ID NO: 45942 - DNA, 71 bp, chicken (Gallus Gallus)
  misc_feature (36): n=c or t
gccagcagaccaaacatacagttcagtcataagccnacaacattaagcattagtaattagtaagagcatgt

SEQ ID NO: 45943 - DNA, 71 bp, chicken (Gallus Gallus)
  misc_feature (36): n=c or t
tacaaaacaaaggacttgtgagagacgaatctgtgngaaggtgaacgagtgaagaaatttctccacattca

SEQ ID NO: 45944 - DNA, 71 bp, chicken (Gallus Gallus)
  misc_feature (36): n=c or t
atgagcattaataatctggttaaataaaattctttnctgtagtcagcaaaagtttgatactgaaacaactg

SEQ ID NO: 45945 - DNA, 71 bp, chicken (Gallus Gallus)
  misc_feature (36): n=a or c
atctataaacattatcagggagataaagagctatcncaaaaccaccaattcttagaactaccacaagtgag

SEQ ID NO: 45946 - DNA, 71 bp, chicken (Gallus Gallus)
  misc_feature (36): n=a or g
agtttggattttgacccagaaaccagtaatttcagnacatactctgtaatcatacttaagttgaacctaag

SEQ ID NO: 45947 - DNA, 71 bp, chicken (Gallus Gallus)
  misc_feature (36): n=c or t
tttgtttacatcaactctgaaactccattcccaccntctttctacatcttacactaccttactcacatgca

SEQ ID NO: 45948 - DNA, 71 bp, chicken (Gallus Gallus)
  misc_feature (36): n=c or t
gggttacctgtcttttcaagccatgtgactgtttgnttcccagctgctgaaaaaggtgatggtaaatttca

SEQ ID NO: 45949 - DNA, 71 bp, chicken (Gallus Gallus)
  misc_feature (36): n=g or t
aatcaaacagacaaacccattcttatattccagtcntcattttttatgcaacttattggaattttaatggt

SEQ ID NO: 45950 - DNA, 71 bp, chicken (Gallus Gallus)
  misc_feature (36): n=a or g
gtaaaatagaatgctgccatttcattaaaatagaanggaaaagaccaagtccctcaagcacttttttcccc

SEQ ID NO: 45951 - DNA, 71 bp, chicken (Gallus Gallus)
  misc_feature (36): n=c or t
ttttccagcataggagcaagttggcctttgctcacngtaaaccaaggaaattaaaccactgctaactaaag

SEQ ID NO: 45952 - DNA, 71 bp, chicken (Gallus Gallus)
  misc_feature (36): n=c or t
caggttgggtgggtggagctgggcgcaggctgggtnacgtttaaggcctgcgtgtatgttgccattgaaaa

SEQ ID NO: 45953 - DNA, 71 bp, chicken (Gallus Gallus)
  misc_feature (36): n=c or t
tgattgtaagacagagtcgagctcaggccaaggtangtttccttatttgtgtaagtgtgtccccaaaatcc

SEQ ID NO: 45954 - DNA, 71 bp, chicken (Gallus Gallus)
  misc_feature (36): n=c or t
taatcatgtgttgatgtaaattgcttttcagatctnttacttcacactcaaaattgcgttagttgtaagta

SEQ ID NO: 45955 - DNA, 71 bp, chicken (Gallus Gallus)
  misc_feature (36): n=c or t
tacttactttggctggccaggagcttttccaaagantgggaccactgtattacttcctctgcagaaagcct

SEQ ID NO: 45956 - DNA, 71 bp, chicken (Gallus Gallus)
  misc_feature (36): n=g or t
gtctctccaatgctcattattcaaaaggaaatctgngtcatgttggtttgtaaggggatttggagcaacta

SEQ ID NO: 45957 - DNA, 71 bp, chicken (Gallus Gallus)
  misc_feature (36): n=a or g
tagctgagcatgtggctatgttttatttccctctgntaccgggaactcttgacaactcttgcaaaaaaaaa

SEQ ID NO: 45958 - DNA, 71 bp, chicken (Gallus Gallus)
  misc_feature (36): n=c or t
atggcctatttctgctatcagtgctatctcatgcanggaaacaagcactgttcccatctttaatgcaaaga

SEQ ID NO: 45959 - DNA, 71 bp, chicken (Gallus Gallus)
  misc_feature (36): n=c or t
tgacaataaagtaggtcactttaatttgacatctgntttttaggttccttatggtctttaaggtaatgtag

SEQ ID NO: 45960 - DNA, 71 bp, chicken (Gallus Gallus)
  misc_feature (36): n=c or t
ccctcaagagcatctgcagagcataatacaagagangcctttcagcaccaagttaaggaagttgctcactt

SEQ ID NO: 45961 - DNA, 71 bp, chicken (Gallus Gallus)
  misc_feature (36): n=c or t
ttgctagacccatcccgggcaatgtagctgaagatnttcaggtcctgcgagtcgtgggacacatagaatat

SEQ ID NO: 45962 - DNA, 71 bp, chicken (Gallus Gallus)
  misc_feature (36): n=c or t
tatataagtaccaggcagcagatccaatactgaganattccatattttgaaatgtactaaaagttatggaa

SEQ ID NO: 45963 - DNA, 71 bp, chicken (Gallus Gallus)
  misc_feature (36): n=a or g
ccgcagtgtcacacatacatctgtggcattgcctcngtggaccaatctttgctttttgtacacacaggctt

SEQ ID NO: 45964 - DNA, 71 bp, chicken (Gallus Gallus)
  misc_feature (36): n=c or t
cacttgggtttgttctgaggttttgaagggaagtangagaagctgttcggatgtcaaatgcgactgtgatt

SEQ ID NO: 45965 - DNA, 71 bp, chicken (Gallus Gallus)
  misc_feature (36): n=c or t
cttcaataagggattcagaggaattaaacataagtnattagtctttgacataagtcaaaagcctttgtcca

SEQ ID NO: 45966 - DNA, 71 bp, chicken (Gallus Gallus)
  misc_feature (36): n=a or g
gcgctggacccacggggtgaaattcgatgacctccnaacgcttcctgggaatggtgcccaaggaggaagct

SEQ ID NO: 45967 - DNA, 71 bp, chicken (Gallus Gallus)
  misc_feature (36): n=c or t
ggggtgccattttgagggagcgctgttttggttgcngccattgtggagagcatactttcgagggttgccat

SEQ ID NO: 45968 - DNA, 71 bp, chicken (Gallus Gallus)
  misc_feature (36): n=c or t
agccacattctgacactaatatggaaaaacaaagcnatgccagaatagcagagaaagagaaatcggtaact

SEQ ID NO: 45969 - DNA, 71 bp, chicken (Gallus Gallus)
  misc_feature (36): n=a or g
ctcaaactgctcccagcaatgaggaagatggggacncaagacctgcctggttaggaccacctggttttttt

SEQ ID NO: 45970 - DNA, 71 bp, chicken (Gallus Gallus)
  misc_feature (36): n=a or c
tatagttcttatttcctaggatctttatcacactgngttcaacaagaaaaacttcagcctggtggcattaa

SEQ ID NO: 45971 - DNA, 71 bp, chicken (Gallus Gallus)
  misc_feature (36): n=a or g
gcttaaataagccaaagaatgtcttggattcctcanagttaaccagatcaattctggaaacgttgacatac

SEQ ID NO: 45972 - DNA, 71 bp, chicken (Gallus Gallus)
  misc_feature (36): n=g or t
attaccattccaaaatccatccaagccaagttgttncctttgaacacctccttcaagtagttggaaccact

SEQ ID NO: 45973 - DNA, 71 bp, chicken (Gallus Gallus)
  misc_feature (36): n=c or t
cagtaaataaattcctctaactttgctcaaatcctngggggtctgaaaacacagagagcactttctaattc

SEQ ID NO: 45974 - DNA, 71 bp, chicken (Gallus Gallus)
  misc_feature (36): n=a or c
ccattagtataataagcaggcaattatgaagaatgngtattatattccagacagccttgatgctgtacaat

SEQ ID NO: 45975 - DNA, 71 bp, chicken (Gallus Gallus)
  misc_feature (36): n=c or t
agtaaaggatgcaaacatagtatactgccaaaacantcagcagaaacagctgacaaacatatatgttattt

SEQ ID NO: 45976 - DNA, 71 bp, chicken (Gallus Gallus)
  misc_feature (36): n=a or g
tgaagctgaagcaaagcaggctttgctagctcttcnaattactcaccttcaaagcctattaatgttttggg

SEQ ID NO: 45977 - DNA, 71 bp, chicken (Gallus Gallus)
  misc_feature (36): n=a or g
taacgtgccaagctggctttttggattcccagcccngaagagatgtggcttttcctcatgactccagaagg

SEQ ID NO: 45978 - DNA, 71 bp, chicken (Gallus Gallus)
  misc_feature (36): n=a or g
taggaacctacgtaccattttcaaaagcagtctagncactaaatggggcatctgcatagccgatttcctat

SEQ ID NO: 45979 - DNA, 71 bp, chicken (Gallus Gallus)
  misc_feature (36): n=a or g
tgggttctcttcccaggtgtctgcatgcactcattnatttctgcccactgcagatttctcacacttattaa

SEQ ID NO: 45980 - DNA, 71 bp, chicken (Gallus Gallus)
  misc_feature (36): n=c or t
cctggtgcattttctgttgtagctgaagtcgctctntttcagtattattgttgcttgacattcctcccaga

SEQ ID NO: 45981 - DNA, 71 bp, chicken (Gallus Gallus)
  misc_feature (36): n=a or g
ctgctgcgtgtctccgtgctgggggctgcaacccgnaatcctcctcctgtatctctcagccacgaaagaaa

SEQ ID NO: 45982 - DNA, 71 bp, chicken (Gallus Gallus)
  misc_feature (36): n=g or t
cggcacttggccaaatctggtctatccggggatgangaggttcaggcttcaccccgggggtgacgccatgg

SEQ ID NO: 45983 - DNA, 71 bp, chicken (Gallus Gallus)
  misc_feature (36): n=a or g
tccattagcaaagcctcttgcaactccccatggccnataccgatcggtacgtcacacctgctgaccagctc

SEQ ID NO: 45984 - DNA, 71 bp, chicken (Gallus Gallus)
  misc_feature (36): n=a or g
tcaaccctacggccggaggaatcgattgtattccgnaccacaatgcctcccatttccataattattattcc

SEQ ID NO: 45985 - DNA, 71 bp, chicken (Gallus Gallus)
  misc_feature (36): n=a or c
gcaatagggtcctggagcaacaaagacctgggcagnatctcctggccccacaactaagcagcaacccacag

SEQ ID NO: 45986 - DNA, 71 bp, chicken (Gallus Gallus)
  misc_feature (36): n=a or g
catgagccagcccaggagagccgtatcccacctctnctggtgagatgcctgaggaaaagccccagccagga

SEQ ID NO: 45987 - DNA, 71 bp, chicken (Gallus Gallus)
  misc_feature (36): n=c or t
ccacagattctcaactgcaggttcagcaagctgtgncccatgaatggccatttcttgacatcctacgtggc

SEQ ID NO: 45988 - DNA, 71 bp, chicken (Gallus Gallus)
  misc_feature (36): n=c or t
aatattgagagaaggaatacctctgctttatattgnatatgtccttctctcagagctgaacaaattgctac

SEQ ID NO: 45989 - DNA, 71 bp, chicken (Gallus Gallus)
  misc_feature (36): n=c or t
gagaatccctctgaactggagtctgctcatcacccnttcactgcccctcatcctttagataccgacctcct

SEQ ID NO: 45990 - DNA, 71 bp, chicken (Gallus Gallus)
  misc_feature (36): n=a or g
aaggcatcagtgtaaatgatggcttaaccaaatggngtcttctgtttatcaattaggtgaagactgtgaag

SEQ ID NO: 45991 - DNA, 71 bp, chicken (Gallus Gallus)
  misc_feature (36): n=a or g
tattgagagctgctgcaaataactaggtcagagccngtgccacagaaccagcttgtaagaggcaccttggc

SEQ ID NO: 45992 - DNA, 71 bp, chicken (Gallus Gallus)
  misc_feature (36): n=c or t
gaggattctccttccatactgaccgcaccaagctcnttggggtgaccacctcctcaccaatcctgacaatg

SEQ ID NO: 45993 - DNA, 71 bp, chicken (Gallus Gallus)
  misc_feature (36): n=a or g
ttacatgcaagcagcacaaagctgtattgctacgcntgcagggaaattacttaaccacatatccaaggtag

SEQ ID NO: 45994 - DNA, 71 bp, chicken (Gallus Gallus)
  misc_feature (36): n=a or g
aacttcacatcagcagggtgccacgcaggcaagaangaagggattcaactccctacaggctaagtaacttt

SEQ ID NO: 45995 - DNA, 71 bp, chicken (Gallus Gallus)
  misc_feature (36): n=g or t
aatgtgtgcagcatcccaacgtcatgactcttggcntactggtgggtttaaatattgcatcccagccaggt

SEQ ID NO: 45996 - DNA, 71 bp, chicken (Gallus Gallus)
  misc_feature (36): n=g or t
ccttctctaagaacaaatattggatattttcctgtntctatgaaattcttctatctaaccacgatcaattt

SEQ ID NO: 45997 - DNA, 71 bp, chicken (Gallus Gallus)
  misc_feature (36): n=a or g
gtggtttggttttgtccttttaagcaggaaactgcnttcattcatgcaaatgtgtacaaaagaagaaaaaa

SEQ ID NO: 45998 - DNA, 71 bp, chicken (Gallus Gallus)
  misc_feature (36): n=a or g
ttgtccattttttagcaggaaaccaaaaatcacacnttgtgcttgtaaaacatttagaagataagtagtga

SEQ ID NO: 45999 - DNA, 71 bp, chicken (Gallus Gallus)
  misc_feature (36): n=c or t
tgtaaagtcaatcacattttcttacagttcagtcanagtatttcaaatctttctcactacagaaagcctta

SEQ ID NO: 46000 - DNA, 71 bp, chicken (Gallus Gallus)
  misc_feature (36): n=c or t
ggtacagatttaaacatctcctcttaaaagcagttngtaatcttggcatagttaataactgcagcactccg

SEQ ID NO: 46001 - DNA, 71 bp, chicken (Gallus Gallus)
  misc_feature (36): n=c or t
gcagacttcagcactccattcttcaggtaattaagnctgttccaggtagaaactcggatgctgcagaagaa

SEQ ID NO: 46002 - DNA, 71 bp, chicken (Gallus Gallus)
  misc_feature (36): n=a or g
cttggtttcctgactcttctgatgtgaaagatgggncaacataatcaacagcatgtggaagctatatgtat

SEQ ID NO: 46003 - DNA, 71 bp, chicken (Gallus Gallus)
  misc_feature (36): n=a or g
agccttgtttccagtgagcaaacaactcagcccacntgacaacacagctcccattcttcttagcatttcta

SEQ ID NO: 46004 - DNA, 71 bp, chicken (Gallus Gallus)
  misc_feature (36): n=a or c
tggtgacagcaggagctggagccactggccttgccntcattgatctggctgtcaacgtgttccaggcaaag

SEQ ID NO: 46005 - DNA, 71 bp, chicken (Gallus Gallus)
  misc_feature (36): n=c or t
actaaacaccaacaagtatcccaacttgtttgttgnagcttttggtcaaaattggcagatgtggtggaaaa

SEQ ID NO: 46006 - DNA, 71 bp, chicken (Gallus Gallus)
  misc_feature (36): n=a or g
aaacatattttggtttgtcctgtcagtgctttatgnggcatgaggactgaggtggggtcctagctctgttt

SEQ ID NO: 46007 - DNA, 71 bp, chicken (Gallus Gallus)
  misc_feature (36): n=c or t
caggaattccacaaatgcacagaaactgctgccagnggggatgcaaagggaacgagatgtgctgtcagatc

SEQ ID NO: 46008 - DNA, 71 bp, chicken (Gallus Gallus)
  misc_feature (36): n=c or t
aatcataattcctgcttcccataaggcttttttttncttctttttacaaattatgttaacaatttcagaat

SEQ ID NO: 46009 - DNA, 71 bp, chicken (Gallus Gallus)
  misc_feature (36): n=a or g
tatatcctctatctcacagctttgggagaataaacnccctgaaagccctctgggatgctcaactcatagcc

SEQ ID NO: 46010 - DNA, 71 bp, chicken (Gallus Gallus)
  misc_feature (36): n=a or g
accctaaatttaaagccaccggggcattcaccaaangaggccctgatgctctggctcccaacaaaaaaccc

SEQ ID NO: 46011 - DNA, 71 bp, chicken (Gallus Gallus)
  misc_feature (36): n=c or t
tggctgttaaatgcttgtgatgtgtatgagctcccngggagtgctgtacagaggtgtttgagaccacttgt

SEQ ID NO: 46012 - DNA, 71 bp, chicken (Gallus Gallus)
  misc_feature (36): n=a or c
tttctcattgcacgtagtgaaggtgcaatgcacacngcgatacctgtaggcagcatttcaattcacaagca

SEQ ID NO: 46013 - DNA, 71 bp, chicken (Gallus Gallus)
  misc_feature (36): n=a or g
caggactgtgcccagcacttgatgaacggagacacnctgagcggtgtctacaccatctccatcaacgggga

SEQ ID NO: 46014 - DNA, 71 bp, chicken (Gallus Gallus)
  misc_feature (36): n=a or g
ctgcacctgagcaaggtacatatggattcattgccnttttctggctgcacagaaacacctggggtgagtac

SEQ ID NO: 46015 - DNA, 71 bp, chicken (Gallus Gallus)
  misc_feature (36): n=c or t
acttcactgagaagcagtcaccagcaccccaaggtntgaagactggatgctcacagaagctttgcagccca

SEQ ID NO: 46016 - DNA, 71 bp, chicken (Gallus Gallus)
  misc_feature (36): n=c or t
ttataaagaagcgttcatggctttagaatttacatnggtattgctttgcaatttaatttctggatacaggg

SEQ ID NO: 46017 - DNA, 71 bp, chicken (Gallus Gallus)
  misc_feature (36): n=a or g
ttctctgtttaagcataaagacttgactcctcagtnagaattacccaaaccctcttgctaccaaagcttcc

SEQ ID NO: 46018 - DNA, 71 bp, chicken (Gallus Gallus)
  misc_feature (36): n=c or t
agtagaacatcctcaacaggacttaacttcattttnacatggaccggcaccagggagaagctcaggtgcct

SEQ ID NO: 46019 - DNA, 71 bp, chicken (Gallus Gallus)
  misc_feature (36): n=a or g
cagcattgtattcaaactggtttaaaggaaaagtgntttagagattggtaatgttattgaatgctcataaa

SEQ ID NO: 46020 - DNA, 71 bp, chicken (Gallus Gallus)
  misc_feature (36): n=a or g
acttcctgctgtgtctttatcaacacagggagctcntttttgttgagataattagtgcaatattctcacct

SEQ ID NO: 46021 - DNA, 71 bp, chicken (Gallus Gallus)
  misc_feature (36): n=c or t
tgatcagagctttggtccgtgtgtttttgcaccagnttgtcagggctgcttaaaaaaagggcacccgttgc

SEQ ID NO: 46022 - DNA, 71 bp, chicken (Gallus Gallus)
  misc_feature (36): n=a or g
cattcacattgttcttaaagctgtccgacaagagcncgttttgctacactgctgaaatgcaattctacaac

SEQ ID NO: 46023 - DNA, 71 bp, chicken (Gallus Gallus)
  misc_feature (36): n=c or t
gtgtgaaaaagacccaggcacacagaaatttccacnttctctgaaaacatatgaggatataactgaaaaag

SEQ ID NO: 46024 - DNA, 71 bp, chicken (Gallus Gallus)
  misc_feature (36): n=a or c
gtagccagaagctctgcaatagttttggaccagagnatggcttagctcataactgggcaaagcgacagtct

SEQ ID NO: 46025 - DNA, 71 bp, chicken (Gallus Gallus)
  misc_feature (36): n=c or t
gagcgcttcatttctggatagcagaccatcacaccnactagttaataagactgcttttaatcttcctcaga

SEQ ID NO: 46026 - DNA, 71 bp, chicken (Gallus Gallus)
  misc_feature (36): n=a or g
aagcctgggaaaagcactgagtggctttgagacacnggatgtggcaggctgccctttgtcactggtaaagg

SEQ ID NO: 46027 - DNA, 71 bp, chicken (Gallus Gallus)
  misc_feature (36): n=a or g
agggaactaaggagccaggcagtatgcagcaaagcnttggtgttgaggtggatgagactgggagatgaggc

SEQ ID NO: 46028 - DNA, 71 bp, chicken (Gallus Gallus)
  misc_feature (36): n=g or t
tttgtacttaataaatatcaaataaaccctgaaaantagttctcctccacacctgaaagcatccaaaagct

SEQ ID NO: 46029 - DNA, 71 bp, chicken (Gallus Gallus)
  misc_feature (36): n=c or t
ttgatcccgtgtagattaactttactaaattcatgnctagttccttctgtagctttgcaccactaaatgtc

SEQ ID NO: 46030 - DNA, 71 bp, chicken (Gallus Gallus)
  misc_feature (36): n=c or t
tgaagctgagaatttcttttttgtggccaagctgtntttccttgtggtcatccttactgaactgaaactgt

SEQ ID NO: 46031 - DNA, 71 bp, chicken (Gallus Gallus)
  misc_feature (36): n=c or t
gtatcaccatgctgtgaaatatcctgaggactttcntcatcaagcataccttcaggcaaggatgaagtcac

SEQ ID NO: 46032 - DNA, 71 bp, chicken (Gallus Gallus)
  misc_feature (36): n=a or g
ttctgcacactgcttatgaagtacaatgtagtcccnagttgataataagatgttagggtcagatacatcaa

SEQ ID NO: 46033 - DNA, 71 bp, chicken (Gallus Gallus)
  misc_feature (36): n=a or g
tttaactcgtgctgtatttgatacatattttatttnagaatatcactttctactgaagaaatgagaacttc

SEQ ID NO: 46034 - DNA, 71 bp, chicken (Gallus Gallus)
  misc_feature (36): n=a or g
tgctttcctactgctccgtatgtatttaagttctcnttcatacatctcacttctagagacataatgcatgc

SEQ ID NO: 46035 - DNA, 71 bp, chicken (Gallus Gallus)
  misc_feature (36): n=a or g
tcatgcattgattcaactgggaaaaattattcactnttgtttaaatataactctccttttctggttttacc

SEQ ID NO: 46036 - DNA, 71 bp, chicken (Gallus Gallus)
  misc_feature (36): n=g or t
acaatcgtacccgctgtgggagctgtaatgctgganacatgctaagccaggggatttgcaagcctgaagtg

SEQ ID NO: 46037 - DNA, 71 bp, chicken (Gallus Gallus)
  misc_feature (36): n=a or c
tagagaaacataaacaattgctgaaataaaaaacantggtgtagaaaatatacaaacagaactttcaacag

SEQ ID NO: 46038 - DNA, 71 bp, chicken (Gallus Gallus)
  misc_feature (36): n=c or t
taataaaagaatttaagatattttttcccatccttnctcacaggagacagagtactatgacatctataaaa

SEQ ID NO: 46039 - DNA, 71 bp, chicken (Gallus Gallus)
  misc_feature (36): n=c or t
aaagataggcaaattactgtgggaatctggaaaganctttctacagatctcttcatttttcctgcagaaga

SEQ ID NO: 46040 - DNA, 71 bp, chicken (Gallus Gallus)
  misc_feature (36): n=c or t
atggataacagaacaataacacctcattccttcctngcacaacttcctaaattctaagaggttttagtctt

SEQ ID NO: 46041 - DNA, 71 bp, chicken (Gallus Gallus)
  misc_feature (36): n=g or t
catacattcctgaatccaaatttaataagatagccnttgagccagatagagattgattaccacatgagcca

SEQ ID NO: 46042 - DNA, 71 bp, chicken (Gallus Gallus)
  misc_feature (36): n=c or t
cctccctgaacaggaaaagacttatgaggcatcacngcagcacagctgccacagaaacagttctggcaaaa

SEQ ID NO: 46043 - DNA, 71 bp, chicken (Gallus Gallus)
  misc_feature (36): n=a or g
tccatcccaaatgctctctgagcccaggaggacacncagcttgactacattacctgttctgatggcaggaa

SEQ ID NO: 46044 - DNA, 71 bp, chicken (Gallus Gallus)
  misc_feature (36): n=a or c
tgaaatcattaatcaaattgcaaatttaactgtcanagagaccaacaacaactggcagggatagactgtgg

SEQ ID NO: 46045 - DNA, 71 bp, chicken (Gallus Gallus)
  misc_feature (36): n=a or g
tccatgcagctctcacctgtgatactcaccttctcnagtggatgagatttctcgtttaactaatactttcc

SEQ ID NO: 46046 - DNA, 71 bp, chicken (Gallus Gallus)
  misc_feature (36): n=a or g
ctatctccctctttactgcctactcatccagtcttncatttgtttattactgtatactttatctctgtctt

SEQ ID NO: 46047 - DNA, 71 bp, chicken (Gallus Gallus)
  misc_feature (36): n=a or c
ccagtcctcctttccctgtgagacttcagccccagnaactccagtccacatttaactgagtccatttcaaa

SEQ ID NO: 46048 - DNA, 71 bp, chicken (Gallus Gallus)
  misc_feature (36): n=a or g
tataaacattactggatcgaaatttgttttgccaanggcaagcattacctctggaaagaattcagctttcc

SEQ ID NO: 46049 - DNA, 71 bp, chicken (Gallus Gallus)
  misc_feature (36): n=c or t
aactgtggtaatccacttcacactgaccttcagatncaattaatttgcagttaatggaatgttatgttcaa

SEQ ID NO: 46050 - DNA, 71 bp, chicken (Gallus Gallus)
  misc_feature (36): n=a or g
agtctaatagtagacctaattgagagaaagctaggnaaagatatcttagtgatgaaacctccaagtgagtt

SEQ ID NO: 46051 - DNA, 71 bp, chicken (Gallus Gallus)
  misc_feature (36): n=c or t
acatatttcccttatcagaaagttttgattaagtancatgtgtggtttgatagagtaactagtactacaca

SEQ ID NO: 46052 - DNA, 71 bp, chicken (Gallus Gallus)
  misc_feature (36): n=a or g
aatttgcttccaaacaaatcaggagacataaaagtnccatactttgccataccaatctcatatggactgaa

SEQ ID NO: 46053 - DNA, 71 bp, chicken (Gallus Gallus)
  misc_feature (36): n=g or t
aagatgtccaagcacttttcagcaaagaaatttttngtcaaaaaatgtcaacttgccaaagcaaaaagcta

SEQ ID NO: 46054 - DNA, 71 bp, chicken (Gallus Gallus)
  misc_feature (36): n=g or t
cagtagtttgggtctctttcagcctcagcaccaaangtgtaagctaaaggtgggttatggttacatctgtg

SEQ ID NO: 46055 - DNA, 71 bp, chicken (Gallus Gallus)
  misc_feature (36): n=c or t
ggttgcagagaaggaaggggtttacagtgatcttcngtgctgcgcttggttcttcatgatggccaggaggg

SEQ ID NO: 46056 - DNA, 71 bp, chicken (Gallus Gallus)
  misc_feature (36): n=c or t
aactatatactttactgccataacaacaaactctantggatgacctagaaccccttccattgtaactgtta

SEQ ID NO: 46057 - DNA, 71 bp, chicken (Gallus Gallus)
  misc_feature (36): n=c or t
agtaaaatccacaattgaacaactgcaatagctgcnccttgatttcaaattaggctaacatatacgcttcc

SEQ ID NO: 46058 - DNA, 71 bp, chicken (Gallus Gallus)
  misc_feature (36): n=a or g
ctgtgcaccccagaagtgcttggtcaggtgttaccnagagtggtgtggcttccagctggactcctcagcca

SEQ ID NO: 46059 - DNA, 71 bp, chicken (Gallus Gallus)
  misc_feature (36): n=a or c
attgtttttttgtttctggagtatatatcgcatagntagagaggctttgtatagggtacgttgtctggctg

SEQ ID NO: 46060 - DNA, 71 bp, chicken (Gallus Gallus)
  misc_feature (36): n=c or t
tttaagtgcttctttctgtagaaaaggtacaaaagnttgcacgaagcaaagacttgaactgagcagtggaa

SEQ ID NO: 46061 - DNA, 71 bp, chicken (Gallus Gallus)
  misc_feature (36): n=a or g
gagggctgatggtacggtgtccgccggcacggtcantcctgcttgcagaggtctgcgacattgaggaacct

SEQ ID NO: 46062 - DNA, 71 bp, chicken (Gallus Gallus)
  misc_feature (36): n=c or t
gcaaaaactcctgcacaatttctcgtccattcttanctccctgggtgcagaggagatgcccttgggaagca

SEQ ID NO: 46063 - DNA, 71 bp, chicken (Gallus Gallus)
  misc_feature (36): n=g or t
cctcaaggatcatgatcttcaaaaattcatatttgntactagaaacttcgatatctataaatgtagacctt

SEQ ID NO: 46064 - DNA, 71 bp, chicken (Gallus Gallus)
  misc_feature (36): n=c or t
tactattctgcttatcagaattctcaggatatcttngcacctctttataattttcttcaaagctctctaac

SEQ ID NO: 46065 - DNA, 71 bp, chicken (Gallus Gallus)
  misc_feature (36): n=a or g
gcagcactggctgaagccccagttttgtctttaatncttttgagtgtggacttgcatggtctcaagtaagc

SEQ ID NO: 46066 - DNA, 71 bp, chicken (Gallus Gallus)
  misc_feature (36): n=c or t
atttctagttccaaagctggtatggattgagacacnttgtcacctagcaaaatccatgtcttcaaattacc

SEQ ID NO: 46067 - DNA, 71 bp, chicken (Gallus Gallus)
  misc_feature (36): n=a or g
tgtttccaccttatgaagcatcctttgtgtatttgncagaacaattatcattctctcccttagtatcgcaa

SEQ ID NO: 46068 - DNA, 71 bp, chicken (Gallus Gallus)
  misc_feature (36): n=c or t
cataagtactctgctcatccaaagattattgttatnctgcaacagcttggctttttctctctgtgaaatct

SEQ ID NO: 46069 - DNA, 71 bp, chicken (Gallus Gallus)
  misc_feature (36): n=a or g
agcaagatggagatgagactttaaagaaggagatcntaatccgtgttcaagtatttatattaaattcaggt

SEQ ID NO: 46070 - DNA, 71 bp, chicken (Gallus Gallus)
  misc_feature (36): n=c or t
tggaaaccaactagagaaggaaatttcagatgctgncactgaacacaagtggtttattgtatctgaggctt

SEQ ID NO: 46071 - DNA, 71 bp, chicken (Gallus Gallus)
  misc_feature (36): n=g or t
tgcttctttttgatttttcaggttctgtttttgtgntttactctctatatgcatggattttaatctatttc

SEQ ID NO: 46072 - DNA, 71 bp, chicken (Gallus Gallus)
  misc_feature (36): n=c or t
catttgagtcttaaactggattcatatttagtgttnctccttatgatgtgggatacttacttctccatgga

SEQ ID NO: 46073 - DNA, 71 bp, chicken (Gallus Gallus)
  misc_feature (36): n=c or t
aaagtaatgtgtgtggtactacgttccctgggggangcacatgaaagtgcccaacaagcttaagacttata

SEQ ID NO: 46074 - DNA, 71 bp, chicken (Gallus Gallus)
  misc_feature (36): n=a or c
aaatctataaagtgcaactcttattgtggtgttgtncaaactggtggcctctcctctccacctattttcct

SEQ ID NO: 46075 - DNA, 71 bp, chicken (Gallus Gallus)
  misc_feature (36): n=a or g
cactccactgcagtagggaccactgtgtattttccnttacttttcataaaactgtaaacaaactgcttcct

SEQ ID NO: 46076 - DNA, 71 bp, chicken (Gallus Gallus)
  misc_feature (36): n=a or c
agctaagcgttggaaggtctcaggaaattaagtttngtttctactggcatgaccttgtctaacaggatggg

SEQ ID NO: 46077 - DNA, 71 bp, chicken (Gallus Gallus)
  misc_feature (36): n=a or g
gatttaacatattcacaaaccactcttacctccggngttcaagaatcgttttccactccggaccacaggat

SEQ ID NO: 46078 - DNA, 71 bp, chicken (Gallus Gallus)
  misc_feature (36): n=c or t
aataagaagagatatatccaaaaagaagcaggtcantctgacaagctggaaaagctcagatactcttattt

SEQ ID NO: 46079 - DNA, 71 bp, chicken (Gallus Gallus)
  misc_feature (36): n=c or t
ttaaaactgtgcatgaacgaatatatttagagtcanagctcaccattgtaccgtacaaatggttacacact

SEQ ID NO: 46080 - DNA, 71 bp, chicken (Gallus Gallus)
  misc_feature (36): n=a or g
cacagttttatgattagcagaaaggtgcctttgctncccccaaacaacatgtatgtcgtttcacagaagtg

SEQ ID NO: 46081 - DNA, 71 bp, chicken (Gallus Gallus)
  misc_feature (36): n=c or t
ttgaagctgtaaaatacgtcactgaaatgaccttanatatgtaaaatccacaagagcatatatgcattgca

SEQ ID NO: 46082 - DNA, 71 bp, chicken (Gallus Gallus)
  misc_feature (36): n=a or g
agacccttgggaaaaaatactgttgtcacagtacanagcaacagaaatgatcctgtcctgtgccccttact

SEQ ID NO: 46083 - DNA, 71 bp, chicken (Gallus Gallus)
  misc_feature (36): n=a or g
gcttgactaagaaacttcacctccaaaaaacaaacncaggattttttgccctctttcattacacagcaaag

SEQ ID NO: 46084 - DNA, 71 bp, chicken (Gallus Gallus)
  misc_feature (36): n=a or g
cagaagtgtatctatgcctcactttcctgttaaaancaaagatgaaaaagtcagctatttaggaataagat

SEQ ID NO: 46085 - DNA, 71 bp, chicken (Gallus Gallus)
  misc_feature (36): n=a or c
tgaacagagatttcttccatccattggcacactggnacttagcaatggtttttggcatgttcctaactgat

SEQ ID NO: 46086 - DNA, 71 bp, chicken (Gallus Gallus)
  misc_feature (36): n=c or t
gcttgttgaggggaaaaatcaccaattctgtgctancgtgatcacttcataaactaaaaagactgatggca

SEQ ID NO: 46087 - DNA, 71 bp, chicken (Gallus Gallus)
  misc_feature (36): n=a or g
taagtaaagcttttaattattcaattataggactcncaaagagtttctttagtgccgttttatacttcaga

SEQ ID NO: 46088 - DNA, 71 bp, chicken (Gallus Gallus)
  misc_feature (36): n=a or g
taccacctacatcctttctctacctgtgattgctcnacagtatgctcattactgcattaaaaacaaaaaag

SEQ ID NO: 46089 - DNA, 71 bp, chicken (Gallus Gallus)
  misc_feature (36): n=a or g
tttagaagttgcccacaaacaaaatgagtatgttanactcaggttccctctgatctctgctaagtttcagt

SEQ ID NO: 46090 - DNA, 71 bp, chicken (Gallus Gallus)
  misc_feature (36): n=a or g
ttaaacagaagatataacaaaccctcagctccacantgttgaaattcaactgcacaggagggctccttttt

SEQ ID NO: 46091 - DNA, 71 bp, chicken (Gallus Gallus)
  misc_feature (36): n=c or t
cccagtggataaaggaatctgtgaatgataaaacgngaagcaaggacagcttgttgcatcgcggggtttgt

SEQ ID NO: 46092 - DNA, 71 bp, chicken (Gallus Gallus)
  misc_feature (36): n=a or g
caagacgtggaacaggtaattactcagaacctctgnctttttaagagactgcttgttaagctcagttctgg

SEQ ID NO: 46093 - DNA, 71 bp, chicken (Gallus Gallus)
  misc_feature (36): n=a or g
agcaaggaagtcaggacatggcagctctaatgtaanactgtgggaagaggagacagctgctttaaaaagca

SEQ ID NO: 46094 - DNA, 71 bp, chicken (Gallus Gallus)
  misc_feature (36): n=a or g
agttcattaataggagaaggaagactgaaaaacgcnttgattcggtggagaaagtgtgtatctacagaaga

SEQ ID NO: 46095 - DNA, 71 bp, chicken (Gallus Gallus)
  misc_feature (36): n=c or t
ctgaaaagcatgccaagggcaaatcttgcaaaaccncctagattacttgacctcaggttcaggaaacaagc

SEQ ID NO: 46096 - DNA, 71 bp, chicken (Gallus Gallus)
  misc_feature (36): n=c or t
cagaaactgaatagagaaagattactgaatgttttncacagtgcaagaactagggagaaccaaatgaaact

SEQ ID NO: 46097 - DNA, 71 bp, chicken (Gallus Gallus)
  misc_feature (36): n=c or t
ggttaagcaaaggcagcagatgacccccattacacnacctattctctaacccagagaaagtcagactgtct

SEQ ID NO: 46098 - DNA, 71 bp, chicken (Gallus Gallus)
  misc_feature (36): n=a or g
ttaaagcaaagagtcaagttctgccatcagtaaccnctggtggcagagcaatcgcttggctgctgactaca

SEQ ID NO: 46099 - DNA, 71 bp, chicken (Gallus Gallus)
  misc_feature (36): n=a or c
agcacttctctagtctcttgggattacattagtgcnccatccggtggctgaattgtgtggtaataagcctg

SEQ ID NO: 46100 - DNA, 71 bp, chicken (Gallus Gallus)
  misc_feature (36): n=a or g
cttaggtcttcactactacaggtggaatttcttccncccactgatggagtgagaatttgtatgtgatttgg

SEQ ID NO: 46101 - DNA, 71 bp, chicken (Gallus Gallus)
  misc_feature (36): n=g or t
caattggtgtatgatgtgtgagtaagctgtcattcntgacgtggaggaaactgactgactcagccttgtta

SEQ ID NO: 46102 - DNA, 71 bp, chicken (Gallus Gallus)
  misc_feature (36): n=a or g
gatgtatgcacagaggattcgggtcctgtgaaaagnagcagtgtcgcatgcagtgccaggaatcacttcac

SEQ ID NO: 46103 - DNA, 71 bp, chicken (Gallus Gallus)
  misc_feature (36): n=c or t
tatttagtgcgtgatgccacacaaattctgcatacnccagtgatatgggtgtatctaaatactgaaaatac

SEQ ID NO: 46104 - DNA, 71 bp, chicken (Gallus Gallus)
  misc_feature (36): n=c or t
tctgctgggagctgcgtgggctgctgaaagagctcngctcacactgatcatgcattaatccactgattatt

SEQ ID NO: 46105 - DNA, 71 bp, chicken (Gallus Gallus)
  misc_feature (36): n=c or t
tccctttaccaggatggctgggctgttcacaaacgngataccgacacccatggacgcaagaagcttctatt

SEQ ID NO: 46106 - DNA, 71 bp, chicken (Gallus Gallus)
  misc_feature (36): n=c or t
ctagaaatcaccttttgatttccactttcctcatcntttgctggttaagaagaagaaaggtaataatctgg

SEQ ID NO: 46107 - DNA, 71 bp, chicken (Gallus Gallus)
  misc_feature (36): n=c or t
ttataaaacaagatagtccctggacatcagtcttancctcttgacagcatatttactgttactaattgctt

SEQ ID NO: 46108 - DNA, 71 bp, chicken (Gallus Gallus)
  misc_feature (36): n=a or c
tgctttaaactcatttgttctctagaaaagacaatnagtctagaagtcaattcataaacatcctggcttgt

SEQ ID NO: 46109 - DNA, 71 bp, chicken (Gallus Gallus)
  misc_feature (36): n=a or g
acgagctctgaataaacagcaggagcctaatgttgnaaatagggattgctctgctgagcgcagctctggca

SEQ ID NO: 46110 - DNA, 71 bp, chicken (Gallus Gallus)
  misc_feature (36): n=c or t
tggtttatctccagcagattaggaattccaggtcangtctattgaccaaacactgagtggtttaaggtgtt

SEQ ID NO: 46111 - DNA, 71 bp, chicken (Gallus Gallus)
  misc_feature (36): n=a or c
ggatttatgaatttgggtgcaagcgtcacactgccntgtctggggacactgtctgaagggcaacgctcact

SEQ ID NO: 46112 - DNA, 71 bp, chicken (Gallus Gallus)
  misc_feature (36): n=a or c
agagaaagtccctcctttggctgctcatcatttcanccctcctgaagctaaactatttttatgtgactgat

SEQ ID NO: 46113 - DNA, 71 bp, chicken (Gallus Gallus)
  misc_feature (36): n=a or g
caatgaagtaccctctagacttggcagatgggtgtngggggaatgtctctgccctctgaaatatttttatt

SEQ ID NO: 46114 - DNA, 71 bp, chicken (Gallus Gallus)
  misc_feature (36): n=a or c
caaccagagcaggatgcaaatactgccatacttaanatgtaagcagtaaaaccgctaagccttgtgtcaga

SEQ ID NO: 46115 - DNA, 71 bp, chicken (Gallus Gallus)
  misc_feature (36): n=a or g
gaacaaaatgtgatcagctagaatagctgctagatnctttgtttttgctaagtctaaccactggcatccac

SEQ ID NO: 46116 - DNA, 71 bp, chicken (Gallus Gallus)
  misc_feature (36): n=a or g
agggacactggggccttcccaaggctgacagcacanagaggggagagcttaacctcacacttctcccaacg

SEQ ID NO: 46117 - DNA, 71 bp, chicken (Gallus Gallus)
  misc_feature (36): n=g or t
gagagctcagtctatggtgcgcaaggttggcttcgntaggatccttgtgtaaagtgctcaggaagaggaaa

SEQ ID NO: 46118 - DNA, 71 bp, chicken (Gallus Gallus)
  misc_feature (36): n=c or t
cccatctggtacataaatctcagagctttaatttcntttacctgtagaatcctgaaaagtatttgccattt

SEQ ID NO: 46119 - DNA, 71 bp, chicken (Gallus Gallus)
  misc_feature (36): n=c or t
aagtgatctcaaatactccatccatgccagtacatngcttaagaaaaatgttatgaggactcttcctgcat

SEQ ID NO: 46120 - DNA, 71 bp, chicken (Gallus Gallus)
  misc_feature (36): n=a or g
taatgcactgaaggctcaatcactaaattagctacnagcccaacacacaaagatcagcagtctttgattct

SEQ ID NO: 46121 - DNA, 71 bp, chicken (Gallus Gallus)
  misc_feature (36): n=a or g
agctcctcgactgaaatcatcaaatgtgagctcctntttatcacagaccagaaccatcaccccaactccag

SEQ ID NO: 46122 - DNA, 71 bp, chicken (Gallus Gallus)
  misc_feature (36): n=a or c
ggtcctggtgcagtgatgatactttttaaggcgttnagctcccatttttagcttatactaccagaggcagc

SEQ ID NO: 46123 - DNA, 71 bp, chicken (Gallus Gallus)
  misc_feature (36): n=a or g
cactgagtgacagaatgaaatacatgcattcacaanatcttctgcagaattctacaactagatggaaaagt

SEQ ID NO: 46124 - DNA, 71 bp, chicken (Gallus Gallus)
  misc_feature (36): n=c or t
gacagggttgtttacttagaacttctcagggagacngacaacacgatcgtcagcaggcagcgtgtcaatgg

SEQ ID NO: 46125 - DNA, 71 bp, chicken (Gallus Gallus)
  misc_feature (36): n=a or g
gagttaaaaagagccaggtaattcttaggacattcntttattgtggatgatgagcagaaaagcactattat

SEQ ID NO: 46126 - DNA, 71 bp, chicken (Gallus Gallus)
  misc_feature (36): n=c or t
cacgtgcttcaaagggagaaccacccagaagacttncagattaggagaccagtaggaaaaacccttctggt

SEQ ID NO: 46127 - DNA, 71 bp, chicken (Gallus Gallus)
  misc_feature (36): n=c or t
ctttccttagctgcactgacactaccctggagatgnctatatgagatgatcgttttacacaagcaatacca

SEQ ID NO: 46128 - DNA, 71 bp, chicken (Gallus Gallus)
  misc_feature (36): n=c or t
ttagagttgcaagaatccatctgaatccagaaaagnggagctttagaacaaatgcccattcttgcaaacat

SEQ ID NO: 46129 - DNA, 71 bp, chicken (Gallus Gallus)
  misc_feature (36): n=g or t
actgaaaaagggagaatgtatattttagatggcagnttccttggctccctgtcttgaagaatgctatttcc

SEQ ID NO: 46130 - DNA, 71 bp, chicken (Gallus Gallus)
  misc_feature (36): n=c or t
tatacagtcctagtaaaattcagcatttgtgctatntaagggggaaattagcatgcttgctgtctgctttt

SEQ ID NO: 46131 - DNA, 71 bp, chicken (Gallus Gallus)
  misc_feature (36): n=a or g
cattttagaagggatgttctagtctaggttatttcnttttgcctgggaatcgcagtattaaattttctatc

SEQ ID NO: 46132 - DNA, 71 bp, chicken (Gallus Gallus)
  misc_feature (36): n=a or g
tttcccccccagtggttaagtaccacctaagctgtntattgtgttgtataactgaattaatgaaagatgaa

SEQ ID NO: 46133 - DNA, 71 bp, chicken (Gallus Gallus)
  misc_feature (36): n=g or t
gccttacaggggcaaacaattccaatagatgtccanaaaaaaatggcacatctgtgtgagaagcaagctga

SEQ ID NO: 46134 - DNA, 71 bp, chicken (Gallus Gallus)
  misc_feature (36): n=a or g
ttggttgcagggttactgtgcgtatgtttctctccntgcattgctaacccttttccatgtcctacagcgag

SEQ ID NO: 46135 - DNA, 71 bp, chicken (Gallus Gallus)
  misc_feature (36): n=g or t
ctgccttcaatttctgtgttgttacaggaattcaangcctctttggcatcctcggctgtgggaaattctac

SEQ ID NO: 46136 - DNA, 71 bp, chicken (Gallus Gallus)
  misc_feature (36): n=a or g
ccgagcccacgtcccacagaagagcagggagccacntccccagtatgcatacgctgatggggacggggacc

SEQ ID NO: 46137 - DNA, 71 bp, chicken (Gallus Gallus)
  misc_feature (36): n=a or g
tacatataaaagcgtgcctgtgtgtgtcctgtaagntatttcattccttagagctccctgaaaccaaagca

SEQ ID NO: 46138 - DNA, 71 bp, chicken (Gallus Gallus)
  misc_feature (36): n=a or g
tccccaaggcctgccctgggttatctcaccgggagngatggccaaaaggagagatttaaggtaatgacaaa

SEQ ID NO: 46139 - DNA, 71 bp, chicken (Gallus Gallus)
  misc_feature (36): n=a or g
aagtatgaaagtgtaagtatcttacaagataatttngggcttcatcttatgtttgcttgaagtcagtagaa

SEQ ID NO: 46140 - DNA, 71 bp, chicken (Gallus Gallus)
  misc_feature (36): n=a or g
gggaacaagcatagccaaaggctcaagggagagatncacatatggtctacgtgtccttagctggaggggct

SEQ ID NO: 46141 - DNA, 71 bp, chicken (Gallus Gallus)
  misc_feature (36): n=g or t
gtgggctctgtgccccctgcctcttccctccctgcnccaacatcacccaacgctgcccacgtgagtctcat

SEQ ID NO: 46142 - DNA, 71 bp, chicken (Gallus Gallus)
  misc_feature (36): n=a or g
tttctcaggaccaagcagcataattaggtactgcanagcaacacataaaattctcatattgcaaatggtat

SEQ ID NO: 46143 - DNA, 71 bp, chicken (Gallus Gallus)
  misc_feature (36): n=c or t
ctggctccacacactgccttcttgtgcattggctcnatgctctctgaactcctatggaatcataaagtcat

SEQ ID NO: 46144 - DNA, 71 bp, chicken (Gallus Gallus)
  misc_feature (36): n=a or g
gactcctgactcccctcagctcaaccttcagccatngagacctctccaaagtgatgctatttcccacattt

SEQ ID NO: 46145 - DNA, 71 bp, chicken (Gallus Gallus)
  misc_feature (36): n=a or g
tctctaattcatccaactataagcttttctaggcanagattttatatttccctaacttctattaaacacca

SEQ ID NO: 46146 - DNA, 71 bp, chicken (Gallus Gallus)
  misc_feature (36): n=a or g
tccaattaccaccatccacttggtgagaatcccagngctctaacatgctgtaaagtttgctactgcagaac

SEQ ID NO: 46147 - DNA, 71 bp, chicken (Gallus Gallus)
  misc_feature (36): n=c or t
tgtttcccaacgtctgcagctatgcagcaatcctcngcctctctttccagatgcacttggaacaatgatta

SEQ ID NO: 46148 - DNA, 71 bp, chicken (Gallus Gallus)
  misc_feature (36): n=a or g
tgtgctctgcagaacaacgtcatcaccacttgtacntcaccagtgctattacacaggactattcaccttgg

SEQ ID NO: 46149 - DNA, 71 bp, chicken (Gallus Gallus)
  misc_feature (36): n=c or t
ctgtgggtgccttatgtaaaaagaatgacttctggncattgtttgctctgtttgcgttagtagggtcagtg

SEQ ID NO: 46150 - DNA, 71 bp, chicken (Gallus Gallus)
  misc_feature (36): n=c or t
acctggtgagaccccaagatacatctgcagctctcntctgcccatgggttcctggtttggccaccccatgc

SEQ ID NO: 46151 - DNA, 71 bp, chicken (Gallus Gallus)
  misc_feature (36): n=g or t
atgcccagctccagtggatggcacggtggtgggtancagtgctctcctggcacagccccgaacccctcagc

SEQ ID NO: 46152 - DNA, 71 bp, chicken (Gallus Gallus)
  misc_feature (36): n=c or t
gcagaggagaggggctgcctgcatttggaaaagcanggggactctgctgcagggcgatgctgagtggtgca

SEQ ID NO: 46153 - DNA, 71 bp, chicken (Gallus Gallus)
  misc_feature (36): n=a or g
attcaatttaatgggattcatcaaagctgattatanctcagtgggatccattaactgcttcctcagtcagt

SEQ ID NO: 46154 - DNA, 71 bp, chicken (Gallus Gallus)
  misc_feature (36): n=a or g
aatattcaggccgacaaaaataattacttcccagcntcgtggggagaaccatctgatggggccgcgcacgg

SEQ ID NO: 46155 - DNA, 71 bp, chicken (Gallus Gallus)
  misc_feature (36): n=c or t
cgtacaaccgtaacagacaggagttaagagtcctgntcacatcagaaagcactgaataacgttgctcatta

SEQ ID NO: 46156 - DNA, 71 bp, chicken (Gallus Gallus)
  misc_feature (36): n=c or t
aagacaatggagagaaaccctaatgcaacagctccnagagggggatgtgataagagactgcagactggacc

SEQ ID NO: 46157 - DNA, 71 bp, chicken (Gallus Gallus)
  misc_feature (36): n=a or g
ctcctacgcatgaagcagagaagcactgtgattacnaatctcaaatagcgcacacagcactgaggttcaca

SEQ ID NO: 46158 - DNA, 71 bp, chicken (Gallus Gallus)
  misc_feature (36): n=a or c
ttcaatttgtggtgttcgagatcaaaaatagaaagntctccaggccctgtcttgctctaccacacatacca

SEQ ID NO: 46159 - DNA, 71 bp, chicken (Gallus Gallus)
  misc_feature (36): n=a or g
ataataagcagttggcgatgtcagggataatcatcngcagtagcagtattatacaaccttcaacgcacctc

SEQ ID NO: 46160 - DNA, 71 bp, chicken (Gallus Gallus)
  misc_feature (36): n=c or t
tttagcttgctttaattctacttttatttcaacaantttgcaaaaattatgttggaaaggggagaaaacag

SEQ ID NO: 46161 - DNA, 71 bp, chicken (Gallus Gallus)
  misc_feature (36): n=a or c
attctgacagcaaattctttagttaattaacacttntcagccacaatataaagcagtcttctaaataaatt

SEQ ID NO: 46162 - DNA, 71 bp, chicken (Gallus Gallus)
  misc_feature (36): n=a or g
ctgcctacatctatactgaaagctttgttccttacntctgaaatctgttggtttctttcagttgaagaagt

SEQ ID NO: 46163 - DNA, 71 bp, chicken (Gallus Gallus)
  misc_feature (36): n=a or g
gatgctgtgagctgagcaaaagccttcactttctcncggatcacttgtattccacgctcatcggaggcatt

SEQ ID NO: 46164 - DNA, 71 bp, chicken (Gallus Gallus)
  misc_feature (36): n=g or t
cttctgtatctgttccctccactgtgctcttctgtntttacagagcaaaaacttgtttgcagctctcaagt

SEQ ID NO: 46165 - DNA, 71 bp, chicken (Gallus Gallus)
  misc_feature (36): n=g or t
gctatgggttggatatatctgctgtagatgatagtnagcaacttggtattactgtgaagtgcacagatccc

SEQ ID NO: 46166 - DNA, 71 bp, chicken (Gallus Gallus)
  misc_feature (36): n=a or g
cagcttgtccttcactaaagggaaacccaaagcatngcctttctttgggcaaaactactgtgagtgataaa

SEQ ID NO: 46167 - DNA, 71 bp, chicken (Gallus Gallus)
  misc_feature (36): n=c or t
tttgttttcatttctgagctatgtaaatatacactncagatgaatcatattttgagtaactcaagaacaat

SEQ ID NO: 46168 - DNA, 71 bp, chicken (Gallus Gallus)
  misc_feature (36): n=a or g
caaaggattttacaaaagctagaagatgtacaaganatgtttgacaagaggcaagtgagtctgaagaagct

SEQ ID NO: 46169 - DNA, 71 bp, chicken (Gallus Gallus)
  misc_feature (36): n=g or t
gcagagactgatatattgcatggagattaaggctcngggcccccagtgagaaatacagacaaactggaata

SEQ ID NO: 46170 - DNA, 71 bp, chicken (Gallus Gallus)
  misc_feature (36): n=a or g
gacaatctaatttcattactctccacttacgtttcnttgtgcaaattctatttgattgtttggatttgggg

SEQ ID NO: 46171 - DNA, 71 bp, chicken (Gallus Gallus)
  misc_feature (36): n=c or t
ccattttggttttttcatactggaagacattcctanatgttcacagactgaagcacagcaaagttaccact

SEQ ID NO: 46172 - DNA, 71 bp, chicken (Gallus Gallus)
  misc_feature (36): n=c or t
gccagggaaggagaactgaacagggcacgcaccgtngtatgccagcttcttactgcagaaatatttaaagg

SEQ ID NO: 46173 - DNA, 71 bp, chicken (Gallus Gallus)
  misc_feature (36): n=a or g
atgaataaggcagcaaggcctgatgccattccagantatcatctccttttggtgtgctgaggtgtgagagg

SEQ ID NO: 46174 - DNA, 71 bp, chicken (Gallus Gallus)
  misc_feature (36): n=a or g
tacattcatgacacttatctttcactgccatcagtnaagttagagattgtcattagagaaagaattaaaca

SEQ ID NO: 46175 - DNA, 71 bp, chicken (Gallus Gallus)
  misc_feature (36): n=a or g
ttctgtattcaaccaagtcttgtgggtagactcganagagagaggggcacagtctttatctaagttaccta

SEQ ID NO: 46176 - DNA, 71 bp, chicken (Gallus Gallus)
  misc_feature (36): n=a or g
aaaacactgctgtgtagtgagcctcacttgtttacnttgtccttgagaaacgtgttggttccagtgccact

SEQ ID NO: 46177 - DNA, 71 bp, chicken (Gallus Gallus)
  misc_feature (36): n=c or t
agcgagccaagaagtaccaaacctgctgcaaggcancgttactgaatttctttagccacagagatcagaga

SEQ ID NO: 46178 - DNA, 71 bp, chicken (Gallus Gallus)
  misc_feature (36): n=a or g
cttgcagaagttactacaggaataagtctcattcancaaccaaagtgacaggtaaatttgcctgtaggatg

SEQ ID NO: 46179 - DNA, 71 bp, chicken (Gallus Gallus)
  misc_feature (36): n=a or g
gcatgacacagccgtaccagttatgcggtaactgcngctcaggacacctgacaacttgttttttgcactac

SEQ ID NO: 46180 - DNA, 71 bp, chicken (Gallus Gallus)
  misc_feature (36): n=c or t
gtcttaaactctgttggggctgccatgctgctccantgtgtatcttagaatgctttttactactcctttaa

SEQ ID NO: 46181 - DNA, 71 bp, chicken (Gallus Gallus)
  misc_feature (36): n=c or t
ggactcctattgacatccatgataattgtgggcatntcatttacatagactcccttcccccccaaaagaac

SEQ ID NO: 46182 - DNA, 71 bp, chicken (Gallus Gallus)
  misc_feature (36): n=g or t
gggagtgtgccattaatggctgtgccaggaacaggngcactctggtagtgttgggacatatgaagtctgct

SEQ ID NO: 46183 - DNA, 71 bp, chicken (Gallus Gallus)
  misc_feature (36): n=a or g
ttaacaatacaccagaatgtttctgtacttgcacanagtgggcagcactgatcctgagtggctttccccac

SEQ ID NO: 46184 - DNA, 71 bp, chicken (Gallus Gallus)
  misc_feature (36): n=c or t
cactgagggaaaaagtatattgcttggaagaaatangacatttataaattttactagaaaaggcattcaag

SEQ ID NO: 46185 - DNA, 71 bp, chicken (Gallus Gallus)
  misc_feature (36): n=a or g
ggtctaagccaggcagctctgctggcacactagggnacacaattagagtctgaaaaagtcttcgtagaaat

SEQ ID NO: 46186 - DNA, 71 bp, chicken (Gallus Gallus)
  misc_feature (36): n=c or t
ccaccagttctttctacaacaggtcgcacaggtcantaggcatcagaccacccctcctctatctatacagt

SEQ ID NO: 46187 - DNA, 71 bp, chicken (Gallus Gallus)
  misc_feature (36): n=c or t
tcaaagcacaaagtgtaacactgcacaggtggaacngactgctctcaagcagagtaagctagttagctttg

SEQ ID NO: 46188 - DNA, 71 bp, chicken (Gallus Gallus)
  misc_feature (36): n=g or t
aaaatccccataattcaaggaatttcccatagagantcatactttccaggtactcaaggacctagcttact

SEQ ID NO: 46189 - DNA, 71 bp, chicken (Gallus Gallus)
  misc_feature (36): n=c or t
ttcagtatcagtaggtgaaatagtaagaggagcagnttctgaacaagcttttctaaacactgaggaagtgt

SEQ ID NO: 46190 - DNA, 71 bp, chicken (Gallus Gallus)
  misc_feature (36): n=a or c
caccaaaaacaaacagaactgataagaaataaacangtaataactgttccagctccctcaatactaccaaa

SEQ ID NO: 46191 - DNA, 71 bp, chicken (Gallus Gallus)
  misc_feature (36): n=a or g
tcacacttccaaaatgagcaaattacagcctgaaancacaaaatacttcaaaatagcaaaatgctttaaaa

SEQ ID NO: 46192 - DNA, 71 bp, chicken (Gallus Gallus)
  misc_feature (36): n=g or t
ccaagtactctgctttcagaaatatagatataaatntatattgacagtgctgtgtaaagtatcttcaaggc

SEQ ID NO: 46193 - DNA, 71 bp, chicken (Gallus Gallus)
  misc_feature (36): n=c or t
tttaaatgtaactgtgctttgatgtataccaggcangctaacttgacagatcctatagctgtaaccttaca

SEQ ID NO: 46194 - DNA, 71 bp, chicken (Gallus Gallus)
  misc_feature (36): n=c or t
gctttcaaggcatatgcttctgctaagtcatatccntgtagaatgtcggccttggggacataatgccagga

SEQ ID NO: 46195 - DNA, 71 bp, chicken (Gallus Gallus)
  misc_feature (36): n=a or c
aaaaccaccaaatatcaggaaccccataatggaagnctgagaatttaaattgtgcaattcaggagcaccgt

SEQ ID NO: 46196 - DNA, 71 bp, chicken (Gallus Gallus)
  misc_feature (36): n=a or g
attttgagtcctgcacctcttttgttccaatctcantgcagaaatggtctcttttctctttaaagcttgca

SEQ ID NO: 46197 - DNA, 71 bp, chicken (Gallus Gallus)
  misc_feature (36): n=c or t
tatatttccccctcaggaatttcattacatattgtnctgcttcatctcagagtacagctagctaagcaaca

SEQ ID NO: 46198 - DNA, 71 bp, chicken (Gallus Gallus)
  misc_feature (36): n=a or g
ctgctacggcattgcttttcagggtttatgactaangtgtggacgctgaaaaaataggtattaggaagaaa

SEQ ID NO: 46199 - DNA, 71 bp, chicken (Gallus Gallus)
  misc_feature (36): n=a or g
agcaaactatttgctttttcatggtaatattgcatnctgatttactgtatgtggcattatgggtagtaact

SEQ ID NO: 46200 - DNA, 71 bp, chicken (Gallus Gallus)
  misc_feature (36): n=a or g
gcacgaggaacatcaaaagcaattcccagcaggatnaatatctgaaactgcatctcatcacaagtgctgcc

SEQ ID NO: 46201 - DNA, 71 bp, chicken (Gallus Gallus)
  misc_feature (36): n=c or t
tctcctacttcctgactgcttccctttgatgtcctncctctcatgtagaggctaacacacacacacacaca

SEQ ID NO: 46202 - DNA, 71 bp, chicken (Gallus Gallus)
  misc_feature (36): n=a or g
gcatagacctgttgtttcctaatctccagatctgcnaagaataggtctgctctgattgttaccgaaggagc

SEQ ID NO: 46203 - DNA, 71 bp, chicken (Gallus Gallus)
  misc_feature (36): n=a or g
gcagtacgactggcaaaatacagtctagtgaaaacnaaatgaaatggaaaagcataaccaaccccttgcag

SEQ ID NO: 46204 - DNA, 71 bp, chicken (Gallus Gallus)
  misc_feature (36): n=a or c
ccccacggctaatgcccaccagcttccctgaaattntgctaggtttctacatctgccatacagctatactt

SEQ ID NO: 46205 - DNA, 71 bp, chicken (Gallus Gallus)
  misc_feature (36): n=a or g
gtacagcaccaaaggtcacggagttatctcctgcancgaactcccttttgatgaattggtaccgttccctg

SEQ ID NO: 46206 - DNA, 71 bp, chicken (Gallus Gallus)
  misc_feature (36): n=a or g
ccaaggagtcagtagatgcaggggatgaatgaacanaattcaaatccctgtcttggaacctcttactggtt

SEQ ID NO: 46207 - DNA, 71 bp, chicken (Gallus Gallus)
  misc_feature (36): n=c or t
ctgaattaatgaaactacgatgctcaaggtcggcangctgtaaatagtaattcagtgctctgcagagtccc

SEQ ID NO: 46208 - DNA, 71 bp, chicken (Gallus Gallus)
  misc_feature (36): n=a or c
ccttttcctgctaccatcagcacagttagatggtangtgaagtcccttgggcgtgttatggtgaatagaac

SEQ ID NO: 46209 - DNA, 71 bp, chicken (Gallus Gallus)
  misc_feature (36): n=a or c
atgatccaagtgcaaggacaaagagatttaaagganggttatttactcaaagagctctccaatttcctgat

SEQ ID NO: 46210 - DNA, 71 bp, chicken (Gallus Gallus)
  misc_feature (36): n=a or g
aaataacaaatttttgagtgttgaatataggtgctntacagtcaatgaggatgtaggggtaaaccatttca

SEQ ID NO: 46211 - DNA, 71 bp, chicken (Gallus Gallus)
  misc_feature (36): n=c or t
cccaattgcatgacaggacaggtccaatggcaactncgaattagtaataaaactgctaaccacctagaaga

SEQ ID NO: 46212 - DNA, 71 bp, chicken (Gallus Gallus)
  misc_feature (36): n=a or g
cacaaataaggatgtaatgtcacccttactaaaccnaaatgaatttgaaaaactcttgattgataacacta

SEQ ID NO: 46213 - DNA, 71 bp, chicken (Gallus Gallus)
  misc_feature (36): n=c or t
gataatttctgcacatacaaaggtattaggaaacanagtgaactattttcagtacacctcatagctatttt

SEQ ID NO: 46214 - DNA, 71 bp, chicken (Gallus Gallus)
  misc_feature (36): n=c or t
cattttctacacagctgacgataacagcttctttgnatgatgcttcaagtagcatacctagatatgttact

SEQ ID NO: 46215 - DNA, 71 bp, chicken (Gallus Gallus)
  misc_feature (36): n=c or t
ttaaaggtgactacagctcatgacaagcaacccagnatattccctatacaaagcaagacaactactggaaa

SEQ ID NO: 46216 - DNA, 71 bp, chicken (Gallus Gallus)
  misc_feature (36): n=a or g
taatccatcacgtgactgacaggactttagtccccnggagaaagtgatttttagcacagttttctatttct

SEQ ID NO: 46217 - DNA, 71 bp, chicken (Gallus Gallus)
  misc_feature (36): n=g or t
tcaggttctggcatcctttatattcatctccaagcntcccccattaactttctatccaccacaacacgtca

SEQ ID NO: 46218 - DNA, 71 bp, chicken (Gallus Gallus)
  misc_feature (36): n=c or t
tcttttgtagaacagagtatctgtattcaagacttntttcattggagatgttcaattacatttggtgatca

SEQ ID NO: 46219 - DNA, 71 bp, chicken (Gallus Gallus)
  misc_feature (36): n=a or c
cctctggactcagtctggaccaaaactctacaatanacgtatagtctgcatattctaaaggaaatggtctg

SEQ ID NO: 46220 - DNA, 71 bp, chicken (Gallus Gallus)
  misc_feature (36): n=c or t
tctgtaggggagaacacgtcctgcactaaacagccntccacacaagagaagataatctagttctcttacac

SEQ ID NO: 46221 - DNA, 71 bp, chicken (Gallus Gallus)
  misc_feature (36): n=a or g
agttttaactgattcatgtgaagggtacttcattcnagtttagcatggagagaaacagggaaaggactaag

SEQ ID NO: 46222 - DNA, 71 bp, chicken (Gallus Gallus)
  misc_feature (36): n=c or t
gtctctctttccccagcacctggagttgcagcattngggcattccaacattcagacaaatcatcaatgctc

SEQ ID NO: 46223 - DNA, 71 bp, chicken (Gallus Gallus)
  misc_feature (36): n=c or t
ttaaattcccagaaccagttcaacaagtgggttaanggcatctctaggcaggttgtgattgagtagattta

SEQ ID NO: 46224 - DNA, 71 bp, chicken (Gallus Gallus)
  misc_feature (36): n=a or c
caaagttcttactattcactgcaggtttaatttganttggccagaaaaagagatttcttcagacaaagcct

SEQ ID NO: 46225 - DNA, 71 bp, chicken (Gallus Gallus)
  misc_feature (36): n=c or t
ctctttctaagcactgggctatgatagtcaaagacntctttaatgaaaagcattataacgttgccatgtaa

SEQ ID NO: 46226 - DNA, 71 bp, chicken (Gallus Gallus)
  misc_feature (36): n=c or t
cctagagcaagcaacacaagtcaattagtcataggnttttgctctttcttttagtccttatgattaaaagc

SEQ ID NO: 46227 - DNA, 71 bp, chicken (Gallus Gallus)
  misc_feature (36): n=c or t
ggtacccagagacctctgccatgatcagagtgacantgtgctgagcgtgccacgaagaattagtaaaaggc

SEQ ID NO: 46228 - DNA, 71 bp, chicken (Gallus Gallus)
  misc_feature (36): n=a or c
gatcagtgctttgtttacagagcccagggtgaaaangactcctaaaaggaaaaggcagaaaatctctacca

SEQ ID NO: 46229 - DNA, 71 bp, chicken (Gallus Gallus)
  misc_feature (36): n=a or c
acaaacactctttcctccatctgccaactacccttnctggtaggaacaacttgggattttgtttcaatttt

SEQ ID NO: 46230 - DNA, 71 bp, chicken (Gallus Gallus)
  misc_feature (36): n=a or c
cttaagtagttttacttatcagttcacagtgacaanatagcactggcaaataactacagacagggagaaaa

SEQ ID NO: 46231 - DNA, 71 bp, chicken (Gallus Gallus)
  misc_feature (36): n=c or t
gatgcttttctgtggattgtagaagatgtgtcattnttaaatggcagatctctcccttgaagtctgtttta

SEQ ID NO: 46232 - DNA, 71 bp, chicken (Gallus Gallus)
  misc_feature (36): n=g or t
atgtttatctatctgcatgtttaaccgtaaggaatntcaaaacagtaagtgcttatttctgcccccaagta

SEQ ID NO: 46233 - DNA, 71 bp, chicken (Gallus Gallus)
  misc_feature (36): n=a or g
caagcaggccatactatgcacagcagaaatttgagnacgacatttaaagcagctagagtttggtggatctc

SEQ ID NO: 46234 - DNA, 71 bp, chicken (Gallus Gallus)
  misc_feature (36): n=c or t
aaacctctgtggttctgagcttctgagggatagaangcacactgctgccaacaggaagtggtgttcagctt

SEQ ID NO: 46235 - DNA, 71 bp, chicken (Gallus Gallus)
  misc_feature (36): n=a or g
ttaactcaaagacagaaaacctgtggtattactgcnttgtctggaatacgaattgggttaggctgaacttc

SEQ ID NO: 46236 - DNA, 71 bp, chicken (Gallus Gallus)
  misc_feature (36): n=c or t
agcctgtacacatctgtgccttacactatttcttgnagctgtacccaagtgcagttcctaggctggtacag

SEQ ID NO: 46237 - DNA, 71 bp, chicken (Gallus Gallus)
  misc_feature (36): n=c or t
ctggcagcacaacaaacagacaagtttccctttgtntatggcaagtttgtaggcagcactgtttgcaaccc

SEQ ID NO: 46238 - DNA, 71 bp, chicken (Gallus Gallus)
  misc_feature (36): n=c or t
ggcatgagatgattgtcaaaaatctggctgacactnttcttgtttctgagctcgtttgcaaatctgtcttc

SEQ ID NO: 46239 - DNA, 71 bp, chicken (Gallus Gallus)
  misc_feature (36): n=a or g
tgctgggccagaaagcttcctgcactctctttcacntgctgtttttccacatacagctatagggaagcgct

SEQ ID NO: 46240 - DNA, 71 bp, chicken (Gallus Gallus)
  misc_feature (36): n=c or t
gcactgttacctccagcgacatatagagagcttaantggcaatcttggtgtactcagtaacgatggcttta

SEQ ID NO: 46241 - DNA, 71 bp, chicken (Gallus Gallus)
  misc_feature (36): n=c or t
tgtcctttgaaagaagaaaggcagtccctgctgcanggccatcccatccatcacagggcaccagggaccag

SEQ ID NO: 46242 - DNA, 71 bp, chicken (Gallus Gallus)
  misc_feature (36): n=a or g
aaaggcagtatccacttaatgcagaaaacagaagtnatgcaaaatcacaaatgaacaccagtttctaatct

SEQ ID NO: 46243 - DNA, 71 bp, chicken (Gallus Gallus)
  misc_feature (36): n=a or g
acccacaaaggtccaagtagttgtcctggaaagaancaggaggtttttatcttactgtttcatgaaatcaa

SEQ ID NO: 46244 - DNA, 71 bp, chicken (Gallus Gallus)
  misc_feature (36): n=g or t
ttgagatgcaaggccagctgaggaggagcagaagantaagctggagttgtattattaacttcctgagtgtt

SEQ ID NO: 46245 - DNA, 71 bp, chicken (Gallus Gallus)
  misc_feature (36): n=a or g
gaagtagtggggccagagatcccttggggagcagcnttcctctgggtgaagtcatcccctttgctttcttc

SEQ ID NO: 46246 - DNA, 71 bp, chicken (Gallus Gallus)
  misc_feature (36): n=c or t
tgaagatagcagtccatgagttgctttgagaaggtnggtgtgatccctgctgtgggagagggagcattcca

SEQ ID NO: 46247 - DNA, 71 bp, chicken (Gallus Gallus)
  misc_feature (36): n=c or t
acggataccaccgcccattgagaggccatcttcctngccgattgtttccaacaagttcctaagaacactga

SEQ ID NO: 46248 - DNA, 71 bp, chicken (Gallus Gallus)
  misc_feature (36): n=g or t
acattttaaagttttctgggtattctttctgttatncactttgtctattggtttatataaccatacagtgg

SEQ ID NO: 46249 - DNA, 71 bp, chicken (Gallus Gallus)
  misc_feature (36): n=a or c
ttctttaaactggataataggagcaggatgataatnataggatgattatttaataatcattaaaataggct

SEQ ID NO: 46250 - DNA, 71 bp, chicken (Gallus Gallus)
  misc_feature (36): n=a or g
ctgacatgcctgcaaaaatatgttccccgctgaccncatgaacaaacacgcgcttcgtgagctacatgatt

SEQ ID NO: 46251 - DNA, 71 bp, chicken (Gallus Gallus)
  misc_feature (36): n=a or c
gagttgtgattcgttgtggtgtgtgaatggtaatgntagtatgaaccacaaaacctggaagagcttgtgat

SEQ ID NO: 46252 - DNA, 71 bp, chicken (Gallus Gallus)
  misc_feature (36): n=a or g
ttaagcatatctaggggatgcacacatgagacactnttccacatctgcacaaccccatcacggtttgcagc

SEQ ID NO: 46253 - DNA, 71 bp, chicken (Gallus Gallus)
  misc_feature (36): n=a or g
aggtcgcaccattttattatgacaggaaggaaaagnatgggagcagacaggcaggcagctggaagatacca

SEQ ID NO: 46254 - DNA, 71 bp, chicken (Gallus Gallus)
  misc_feature (36): n=a or c
cccccagctgcttttgcaacagactgatttccctgncaaatgcccatttaaacacacttttaaattgtatt

SEQ ID NO: 46255 - DNA, 71 bp, chicken (Gallus Gallus)
  misc_feature (36): n=a or g
tttgtctccttttgctagaagaaatattatggtcanattcagaaattagtatattactaccgaggaagatc

SEQ ID NO: 46256 - DNA, 71 bp, chicken (Gallus Gallus)
  misc_feature (36): n=a or g
gcagtgagagcaaacagacattaagatatccccaanagtttctttcaacaatgcaattaagtcaaaacatt

SEQ ID NO: 46257 - DNA, 71 bp, chicken (Gallus Gallus)
  misc_feature (36): n=g or t
caaaagagagagaagaaataaatacccaagagaganatgacagagctgaatcttttcatctaccaagaagg

SEQ ID NO: 46258 - DNA, 71 bp, chicken (Gallus Gallus)
  misc_feature (36): n=c or t
aatgctcagagacatcttaatagcttttttccaccngtgcttcctattgatgttcctctgtgtgtctcaag

SEQ ID NO: 46259 - DNA, 71 bp, chicken (Gallus Gallus)
  misc_feature (36): n=c or t
ctgctctgggtcagagtgctcctcagtgcagctcangtctctgcagtcagccttttcgcttgtttcagtgc

SEQ ID NO: 46260 - DNA, 71 bp, chicken (Gallus Gallus)
  misc_feature (36): n=a or g
tgattttagtacaaatatctcctcttaccagacatngcagtgaggtcagcactacggctgaacacttctgt

SEQ ID NO: 46261 - DNA, 71 bp, chicken (Gallus Gallus)
  misc_feature (36): n=a or g
atgaggtggtatatttcaaaaactatttcctgttcntaccagtagaaacaaaattcttcctatttactcca

SEQ ID NO: 46262 - DNA, 71 bp, chicken (Gallus Gallus)
  misc_feature (36): n=c or t
tgacaaccaaggatttgtgcccgcaagtatcactgngtgaagtgggctattgaaagcaaaatctatttgct

SEQ ID NO: 46263 - DNA, 71 bp, chicken (Gallus Gallus)
  misc_feature (36): n=c or t
tgtaacaatatgtgggcaatagaaggttccagagangcttcttattgtaaattcagctgtgctatgggaaa

SEQ ID NO: 46264 - DNA, 71 bp, chicken (Gallus Gallus)
  misc_feature (36): n=c or t
caattaaaggttaatggaagtgtttgacaaaaatantgtgcaattattcatcttaaatttacagatgcaaa

SEQ ID NO: 46265 - DNA, 71 bp, chicken (Gallus Gallus)
  misc_feature (36): n=a or g
aaaacaaaagtgggctggccacagaaagtagtaagngaacaagatgattaatggctttccattatgcttct

SEQ ID NO: 46266 - DNA, 71 bp, chicken (Gallus Gallus)
  misc_feature (36): n=c or t
ccatacattttgtctggcattttcctttgaaaaccngacaggtagtgaagtctcacactgactgtaaaatt

SEQ ID NO: 46267 - DNA, 71 bp, chicken (Gallus Gallus)
  misc_feature (36): n=c or t
agcattatttcagttacagtactgacattttaaaantgtatgccagaaagaatttgatcttatctttcatc

SEQ ID NO: 46268 - DNA, 71 bp, chicken (Gallus Gallus)
  misc_feature (36): n=c or t
agtagaatagggagatatgagcatgtataataatanaaatactcaattttatataaaatcatgtagcttac

SEQ ID NO: 46269 - DNA, 71 bp, chicken (Gallus Gallus)
  misc_feature (36): n=a or g
tgccaaaagggcctttgggagcaggttttgtttgcnccatctactgtacaaatgcatagtctcttcgttga

SEQ ID NO: 46270 - DNA, 71 bp, chicken (Gallus Gallus)
  misc_feature (36): n=a or g
cagaaggatatgcgagcagtgccttgagagtgaatnctattattaatgattacttttgcagtaaaaacgca

SEQ ID NO: 46271 - DNA, 71 bp, chicken (Gallus Gallus)
  misc_feature (36): n=a or g
gtttgggtttttctaacctgacttcttttggaattnagcacctgaatacttttgtccatctgagactctgt

SEQ ID NO: 46272 - DNA, 71 bp, chicken (Gallus Gallus)
  misc_feature (36): n=c or t
tggtttagaaagcaactttccaagtagttggagacntcttgtaaagggaggagaggaggacttcaggaacc

SEQ ID NO: 46273 - DNA, 71 bp, chicken (Gallus Gallus)
  misc_feature (36): n=c or t
gctgtattaacccatattgaaggggcctttgcctcncataatgctcacaagatttgtttaaatgtggcaat

SEQ ID NO: 46274 - DNA, 71 bp, chicken (Gallus Gallus)
  misc_feature (36): n=c or t
taaggactgatagccttgcagctcggctgcataccngctcgggcttttattccatcttgaatttcccaggg

SEQ ID NO: 46275 - DNA, 71 bp, chicken (Gallus Gallus)
  misc_feature (36): n=c or t
tgtggtcatggccattagctctggtgctctgctatnactgagctgtcctgttcaaggaatggtcatgttga

SEQ ID NO: 46276 - DNA, 71 bp, chicken (Gallus Gallus)
  misc_feature (36): n=c or t
ctctgtaatccacactagtagcagtggattttgacnaatcttcatctatacctgcagactgttttaaagaa

SEQ ID NO: 46277 - DNA, 71 bp, chicken (Gallus Gallus)
  misc_feature (36): n=a or g
attttcaagtttggtctctccattgctcggctgaanatgtgggctcacgttttagttaaaatcattttttt

SEQ ID NO: 46278 - DNA, 71 bp, chicken (Gallus Gallus)
  misc_feature (36): n=c or t
agagcccccatctttctttagacttcaaaatacaanatttaggcagatgcaggcatagaaatgtttagatg

SEQ ID NO: 46279 - DNA, 71 bp, chicken (Gallus Gallus)
  misc_feature (36): n=a or c
gtaaagctggatctcaatgcctcagtaatagggagnaatgaaaggaagaaatacagtagtcaatagcacaa

SEQ ID NO: 46280 - DNA, 71 bp, chicken (Gallus Gallus)
  misc_feature (36): n=c or t
tgacacttagcactgattaactcagccatgaatcanatcatggtagcaagtagtgcgagtttcccagctta

SEQ ID NO: 46281 - DNA, 71 bp, chicken (Gallus Gallus)
  misc_feature (36): n=a or c
aatagagcttcatattaaatcatagccaatgtctancagcagttcgtgttctttttcagatatgtccactg

SEQ ID NO: 46282 - DNA, 71 bp, chicken (Gallus Gallus)
  misc_feature (36): n=a or g
gaccatgaacattttggcaagtgacacaaagcaacnggaggttgctgagatagatgcgctgtatgcaaccc

SEQ ID NO: 46283 - DNA, 71 bp, chicken (Gallus Gallus)
  misc_feature (36): n=a or g
gacagctagatcagagagctgaacagtgcagccccnatagatcccaccaaatgccagtgcaactcaccctg

SEQ ID NO: 46284 - DNA, 71 bp, chicken (Gallus Gallus)
  misc_feature (36): n=c or t
aagaaggaaaaggagttccttgcatcggtcttgtanaagcgttcaagctagacataaaatactacaaagac

SEQ ID NO: 46285 - DNA, 71 bp, chicken (Gallus Gallus)
  misc_feature (36): n=c or t
aaagagattcgtgtctgtcccaggaacctccatccncaggaaatgcttgtgatttctataactttaactta

SEQ ID NO: 46286 - DNA, 71 bp, chicken (Gallus Gallus)
  misc_feature (36): n=c or t
ctccctctgcaccagggttgaaatagttcttatgcnatgtgtatgggagaaacagcctataaatagtagct

SEQ ID NO: 46287 - DNA, 71 bp, chicken (Gallus Gallus)
  misc_feature (36): n=a or g
ttcaggaaatatcttcaacctgaacatgccccacantcattttaatgcatttccaacattccctgaaagca

SEQ ID NO: 46288 - DNA, 71 bp, chicken (Gallus Gallus)
  misc_feature (36): n=a or c
tttcccctgcaaaagcaatcaaatcatattctgagntagaataaacctttaggaaaaatactcaaaggctg

SEQ ID NO: 46289 - DNA, 71 bp, chicken (Gallus Gallus)
  misc_feature (36): n=a or g
tatccctcagtgctgcaaccccagatataaccccantgactcttctctgtgcttttaaacctagaaaatcc

SEQ ID NO: 46290 - DNA, 71 bp, chicken (Gallus Gallus)
  misc_feature (36): n=a or g
acagtttctcagcaaatcttaacaaaaactaaagangaggaagactccaagtatctaaaaacaataattat

SEQ ID NO: 46291 - DNA, 71 bp, chicken (Gallus Gallus)
  misc_feature (36): n=a or g
aagtgcagaaacaaaatctgctataattgaaaactnaaaatgacaatgtctccctcccgttgagccctgcc

SEQ ID NO: 46292 - DNA, 71 bp, chicken (Gallus Gallus)
  misc_feature (36): n=c or t
aacatgtctgagcagcaacatgtgggaggtgccagncagttttccagagtcaggcaccaagtctggtagat

SEQ ID NO: 46293 - DNA, 71 bp, chicken (Gallus Gallus)
  misc_feature (36): n=c or t
gtctctgcagtcagtgaagacttctccaaccatganatgcaagtacaacctgtatttacatcattaaatat

SEQ ID NO: 46294 - DNA, 71 bp, chicken (Gallus Gallus)
  misc_feature (36): n=a or g
atgaaggagaaaattgaaaaatccctgttagatagntacgtgctccacaatcctggtgaattaaatcagga

SEQ ID NO: 46295 - DNA, 71 bp, chicken (Gallus Gallus)
  misc_feature (36): n=a or g
cataaaaatagataaaactcaaacaacttgactcanatagccattttaaaatggacacaaaaattacctca

SEQ ID NO: 46296 - DNA, 71 bp, chicken (Gallus Gallus)
  misc_feature (36): n=a or g
cttctccctccgattgtgtcagtacccaacaggcantaactcattgacagcaggacagagtgtctgctagg

SEQ ID NO: 46297 - DNA, 71 bp, chicken (Gallus Gallus)
  misc_feature (36): n=c or t
ataactatttttagtttattctgttctgtctgcaancaaaaggacttggtggcttttgcacagcagtaaag

SEQ ID NO: 46298 - DNA, 71 bp, chicken (Gallus Gallus)
  misc_feature (36): n=a or g
atatctttacttctttctaagtcacgttactgaaancaagttgctcacttccagtctttgaagggatcgtg

SEQ ID NO: 46299 - DNA, 71 bp, chicken (Gallus Gallus)
  misc_feature (36): n=a or g
ctgtaagtaagcacaggaaagaaagcctggtgaagnacagtgttaaaagagtgagagcactaaaactaatt

SEQ ID NO: 46300 - DNA, 71 bp, chicken (Gallus Gallus)
  misc_feature (36): n=a or g
aaaatcaagaatctgttatggtccagatcgattccntgacttcgaagaagaataccaacatctttgaatgt

SEQ ID NO: 46301 - DNA, 71 bp, chicken (Gallus Gallus)
  misc_feature (36): n=a or c
caacaagagcaatgcccaacctaggtgcacctgganattagtatggtgaggaacatccccacaatcacaca

SEQ ID NO: 46302 - DNA, 71 bp, chicken (Gallus Gallus)
  misc_feature (36): n=a or g
ttttttttttgccattttatttacatgggctttctngattgtcaggcacactcgggtttgctaaggacatg

SEQ ID NO: 46303 - DNA, 71 bp, chicken (Gallus Gallus)
  misc_feature (36): n=a or g
gttttgttgttacctatagaaagacaaagctgttgntgcctctttgatctaggaaaaaggatttccttctg

SEQ ID NO: 46304 - DNA, 71 bp, chicken (Gallus Gallus)
  misc_feature (36): n=c or t
aagctgcagcattttcagaatactgcactccaaaangtgcccaagggctgagatgctcctcatgtcaccac

SEQ ID NO: 46305 - DNA, 71 bp, chicken (Gallus Gallus)
  misc_feature (36): n=a or g
tataacttattttttcacaccaggttcaacctgcantataggtgacactacagctgcacaaacattgcagt

SEQ ID NO: 46306 - DNA, 71 bp, chicken (Gallus Gallus)
  misc_feature (36): n=c or t
tgtgacagcaattggctaccaacatagagcgattcnggaaagtctgggctgtcacctttggagtttattac

SEQ ID NO: 46307 - DNA, 71 bp, chicken (Gallus Gallus)
  misc_feature (36): n=a or g
gtgtggggctgcgtagctgtatcctaattacgtacntctcctgatttctctctctttcgggtcccttcggg

SEQ ID NO: 46308 - DNA, 71 bp, chicken (Gallus Gallus)
  misc_feature (36): n=c or t
attattaataactcagactagcattgttaatactcnaggttctgactacatcacagcatttgtgtaaaaac

SEQ ID NO: 46309 - DNA, 71 bp, chicken (Gallus Gallus)
  misc_feature (36): n=a or g
aacggtaaattgtttgcttccaacaaaatcgaggcnctcctgagttcttcctactgctatctgatattgat

SEQ ID NO: 46310 - DNA, 71 bp, chicken (Gallus Gallus)
  misc_feature (36): n=a or c
ttcatacaatttcttctccatctcactcacagctanctaacaattgcagcccttatgagaaactatgtatt

SEQ ID NO: 46311 - DNA, 71 bp, chicken (Gallus Gallus)
  misc_feature (36): n=a or g
gacggagcgctcccatcgcaccgaagagaaccccanataatcggcaccgtttgcggagccctctcggccgc

SEQ ID NO: 46312 - DNA, 71 bp, chicken (Gallus Gallus)
  misc_feature (36): n=g or t
tttaagcacccatcctgcccggggttgcacgaaganggcttgggaaggaggggactcttggagcacatccc

SEQ ID NO: 46313 - DNA, 71 bp, chicken (Gallus Gallus)
  misc_feature (36): n=c or t
tcgctggttctctccccagcttgttattgcagctgnggatctcattttcacacttgtaaaataaacctgtt

SEQ ID NO: 46314 - DNA, 71 bp, chicken (Gallus Gallus)
  misc_feature (36): n=a or c
cattggacttttttcctgaaggttctccaatatcgncccctagtccatctccgctacctcgtaccccaacc

SEQ ID NO: 46315 - DNA, 71 bp, chicken (Gallus Gallus)
  misc_feature (36): n=a or g
aagccttctggcaaagacgaggacacgccgcatgcnaaaattgcatctgatatcatgagctgcatcttgca

SEQ ID NO: 46316 - DNA, 71 bp, chicken (Gallus Gallus)
  misc_feature (36): n=c or t
ataccgacacagaatcccctgtaccactgggcaatntgaaatctgttgtgaatggaaatgaagaagatgaa

SEQ ID NO: 46317 - DNA, 71 bp, chicken (Gallus Gallus)
  misc_feature (36): n=c or t
ggaaccagcgtctgtcactgccaggagctctctagnccctctcaaaagatgaatcttaatttctcttcctt

SEQ ID NO: 46318 - DNA, 71 bp, chicken (Gallus Gallus)
  misc_feature (36): n=c or t
tccaggctggagctttgaccctttgcctttttgctngcatgcctgcagctacaaactggttggtggtgtta

SEQ ID NO: 46319 - DNA, 71 bp, chicken (Gallus Gallus)
  misc_feature (36): n=a or g
agtttgatctggacatcttgtagcttcttttcaagnatttctgcctccatccgtaagctgttggtggcact

SEQ ID NO: 46320 - DNA, 71 bp, chicken (Gallus Gallus)
  misc_feature (36): n=a or c
acttaaagggaatgtctatttccattaaagacatanaaattcatttcattgtaaatatataggactccggg

SEQ ID NO: 46321 - DNA, 71 bp, chicken (Gallus Gallus)
  misc_feature (36): n=c or t
cacagctttgcattcttaatatacagccttacgtgngcgtgcagacctgctgcacagataatcttcctctc

SEQ ID NO: 46322 - DNA, 71 bp, chicken (Gallus Gallus)
  misc_feature (36): n=a or g
ctgactcgctcggtccttacagacccgcacagctcngtacggactcgctccgcaccgtccccccgccgcac

SEQ ID NO: 46323 - DNA, 71 bp, chicken (Gallus Gallus)
  misc_feature (36): n=g or t
gctttcctgaagtttggttgttgtggagacctaganaatgtttgacagcagtcctccagaatatattcttt

SEQ ID NO: 46324 - DNA, 71 bp, chicken (Gallus Gallus)
  misc_feature (36): n=c or t
tggcacaacctcatgttctttcaaagggcccaatangaccaaaccagaatgttttcagcctgtgtatgagt

SEQ ID NO: 46325 - DNA, 71 bp, chicken (Gallus Gallus)
  misc_feature (36): n=c or t
cagtgggggaaaaagaaagtaattcatacctagaangtcatacatgggtcacagtaagattcctttattct

SEQ ID NO: 46326 - DNA, 71 bp, chicken (Gallus Gallus)
  misc_feature (36): n=c or t
ctgtgtggtctaactctgattcctaatcatccattnggtttaattcatgatttcagaaaggaagcattttt

SEQ ID NO: 46327 - DNA, 71 bp, chicken (Gallus Gallus)
  misc_feature (36): n=c or t
gtttaaatcctgcctctgtgtggcccagccccaaangtctttgtttggcttttggaagagctgaggagcat

SEQ ID NO: 46328 - DNA, 71 bp, chicken (Gallus Gallus)
  misc_feature (36): n=a or g
tgctccatgagcctgcagggactacagaggggtagngatggccctccgagctcacgggattcctcagtctg

SEQ ID NO: 46329 - DNA, 71 bp, chicken (Gallus Gallus)
  misc_feature (36): n=a or g
tcatctgatggaagactgaggattgcacatgaactntgcacactgagtcatgaggatttgctttatgaccc

SEQ ID NO: 46330 - DNA, 71 bp, chicken (Gallus Gallus)
  misc_feature (36): n=c or t
tccaacatacattcctttgttttctgcaccttcttngccgtaggatttcatatacaccaacattagaaagg

SEQ ID NO: 46331 - DNA, 71 bp, chicken (Gallus Gallus)
  misc_feature (36): n=a or g
gtcaagcatgtatttgttcctcttttgcctgcaagnaaaacatctgccgttgttcattaaaaggaattctc

SEQ ID NO: 46332 - DNA, 71 bp, chicken (Gallus Gallus)
  misc_feature (36): n=c or t
aaatcctcagggcctgcacactccaatctctgccgntctggaagtgatgattcagcgtcagcacggtgctg

SEQ ID NO: 46333 - DNA, 71 bp, chicken (Gallus Gallus)
  misc_feature (36): n=a or g
tttccccacgcttaaagccaccatttctgtgtgcancttaaatagaagcaatctcataccctcatcatctg

SEQ ID NO: 46334 - DNA, 71 bp, chicken (Gallus Gallus)
  misc_feature (36): n=a or g
gaaatgatttaaatatgggattcatgttaccacacnggtactaagcagtaagttattcagaaaattttaat

SEQ ID NO: 46335 - DNA, 71 bp, chicken (Gallus Gallus)
  misc_feature (36): n=a or g
ttgaagtaaggtgccttggctgacagataaattgcngtggtattatggtaaagcatagttaatcacagcat

SEQ ID NO: 46336 - DNA, 71 bp, chicken (Gallus Gallus)
  misc_feature (36): n=g or t
tgcattttatttttggtcttctgtgaaaaatttttnatgatgaacagaggaaaatgaacccttcctatact

SEQ ID NO: 46337 - DNA, 71 bp, chicken (Gallus Gallus)
  misc_feature (36): n=a or g
ggtgccaggggacaatgtttgcaggtgacagacacntgtcccacattttttggtcacttaggtaatccctg

SEQ ID NO: 46338 - DNA, 71 bp, chicken (Gallus Gallus)
  misc_feature (36): n=a or g
cgcacaaaccacgtggaaccttcctgacagacagtncggagacagtttacatggaacttgctgacagacag

SEQ ID NO: 46339 - DNA, 71 bp, chicken (Gallus Gallus)
  misc_feature (36): n=c or t
tgaatgacatgctgtgtatgctactttatttcatanatgtgattttgcaaggccgatttatttttcctgtt

SEQ ID NO: 46340 - DNA, 71 bp, chicken (Gallus Gallus)
  misc_feature (36): n=a or c
aatagatcacaatgagactacaaagataagacaatncttcattgctgctgaagagattatctggaattatg

SEQ ID NO: 46341 - DNA, 71 bp, chicken (Gallus Gallus)
  misc_feature (36): n=a or g
caatgtacaaaggcacgtttggcatacatcaaatcnaacttatggtcaagacgagcccaagcttcagcaat

SEQ ID NO: 46342 - DNA, 71 bp, chicken (Gallus Gallus)
  misc_feature (36): n=g or t
gggcattgtggttctttgtggcgctggcctttgtgnacacatgtgccaagcagttttaattcttgttttag

SEQ ID NO: 46343 - DNA, 71 bp, chicken (Gallus Gallus)
  misc_feature (36): n=a or c
tgctcccatagtaccagcaacagagaagtgcatcangccaagctgtggggaataaccctcagtgcccgcct

SEQ ID NO: 46344 - DNA, 71 bp, chicken (Gallus Gallus)
  misc_feature (36): n=a or g
tttcaaattcctcccgagaagttctgctggaaaaancaacagcaacaaaagccctgcagaatatacatatt

SEQ ID NO: 46345 - DNA, 71 bp, chicken (Gallus Gallus)
  misc_feature (36): n=a or g
cctctgtatttggatgagatagttacagttgcatcngggatttatttgcgacctcatctttcctttaacac

SEQ ID NO: 46346 - DNA, 71 bp, chicken (Gallus Gallus)
  misc_feature (36): n=c or t
gaagactttctcagcttaagttgtactgcctctctnagtatcataaggctaaccatcattctggtgagtga

SEQ ID NO: 46347 - DNA, 71 bp, chicken (Gallus Gallus)
  misc_feature (36): n=a or c
atacacaaatcactgtgcttgcctgaacagagacanggaatagcaggaggctgttttctcgtggtgcagag

SEQ ID NO: 46348 - DNA, 71 bp, chicken (Gallus Gallus)
  misc_feature (36): n=a or g
gaagaacctttcagtgtaacggagcgaagcttcacnatatttgctgtttcttggtgcaaagaagacaggct

SEQ ID NO: 46349 - DNA, 71 bp, chicken (Gallus Gallus)
  misc_feature (36): n=a or g
cctatttaagaatatgccctagcatcattctgtgantccttttgtgattgaagttcacatcggaccacgct

SEQ ID NO: 46350 - DNA, 71 bp, chicken (Gallus Gallus)
  misc_feature (36): n=c or t
gtttgtgtccacctgatagtacttgcctttggccantgaccaatcaactgtttgaaaaccattcctctacc

SEQ ID NO: 46351 - DNA, 71 bp, chicken (Gallus Gallus)
  misc_feature (36): n=a or g
atgcatctaaatactgctgcctttcctcgcacagcnttccttcaagtctgaaaagggaaatagcaccaact

SEQ ID NO: 46352 - DNA, 71 bp, chicken (Gallus Gallus)
  misc_feature (36): n=a or c
gaaggtctgtcagaagatacaaaaggagaaaacaangctgaagaactaggaagttcctttcatcctacagt

SEQ ID NO: 46353 - DNA, 71 bp, chicken (Gallus Gallus)
  misc_feature (36): n=c or t
cattaccaaaacaccccttacatcaacaagcactgntggtttcgagtacttagggaggactacaacatttt

SEQ ID NO: 46354 - DNA, 71 bp, chicken (Gallus Gallus)
  misc_feature (36): n=c or t
tacatttgaatgaagtagtgcatgccaggaattacnagaaagatcaataagcggtgcaggagaaagatgtc

SEQ ID NO: 46355 - DNA, 71 bp, chicken (Gallus Gallus)
  misc_feature (36): n=a or g
tttttgtattccagttagaaatagacagtagtagantaagtgcagatctacaagaggaacatcacttttta

SEQ ID NO: 46356 - DNA, 71 bp, chicken (Gallus Gallus)
  misc_feature (36): n=c or t
tggctctttgcaatcagtatttccacagaagctcantgaagcaaggaaatcatataaatgactctctcctg

SEQ ID NO: 46357 - DNA, 71 bp, chicken (Gallus Gallus)
  misc_feature (36): n=a or g
tgaggagaattcacccaagcaccctcataatcatanggtccatccaagtaaatcacttgcttcttggggtc

SEQ ID NO: 46358 - DNA, 71 bp, chicken (Gallus Gallus)
  misc_feature (36): n=c or t
ctggaggagcagtttgctgccagagtagaagggganattgagtggaggtgtggaagagcacgtcctgtttc

SEQ ID NO: 46359 - DNA, 71 bp, chicken (Gallus Gallus)
  misc_feature (36): n=c or t
gctactggctcagggcatctcttacaacacgcctgngcagtgtttgtgcaaacaaaaggaaccacgtttct

SEQ ID NO: 46360 - DNA, 71 bp, chicken (Gallus Gallus)
  misc_feature (36): n=c or t
actcatttgatgatatactgcttctgccatcagtantggtgtagatcttacacaaggtgtcattcataacc

SEQ ID NO: 46361 - DNA, 71 bp, chicken (Gallus Gallus)
  misc_feature (36): n=a or g
atcattttgccaaaatgttgagcgcctactgggganagattgagtgtattgaataaaggtgaacgttaatt

SEQ ID NO: 46362 - DNA, 71 bp, chicken (Gallus Gallus)
  misc_feature (36): n=g or t
tttcagttaattcaatggaaatggaatcaggttttntactgagtttggatttcctttatctgcttagggcc

SEQ ID NO: 46363 - DNA, 71 bp, chicken (Gallus Gallus)
  misc_feature (36): n=a or g
agcaccttcaacaaaacgctccctgaactgcagcgntttcacacaatccccattcccagcctctttgagta

SEQ ID NO: 46364 - DNA, 71 bp, chicken (Gallus Gallus)
  misc_feature (36): n=a or g
caacctcctgagtcagctttaccaaatctgttacangcgtgctaattaattaataagaattaattagtcac

SEQ ID NO: 46365 - DNA, 71 bp, chicken (Gallus Gallus)
  misc_feature (36): n=c or t
cagacctaatggtgagacggcctttcccagctacantaagggctgcttcttgtggactggaagtattgcca

SEQ ID NO: 46366 - DNA, 71 bp, chicken (Gallus Gallus)
  misc_feature (36): n=a or g
gctcttggcagaggggaatagcactttgatccttgncctgagatagcgtaaacagagtgttgttaaggcag

SEQ ID NO: 46367 - DNA, 71 bp, chicken (Gallus Gallus)
  misc_feature (36): n=g or t
gtgattgatactgatttgaattgttatgcaaatacncttctgctggtctctctgctgcagttctcccaggt

SEQ ID NO: 46368 - DNA, 71 bp, chicken (Gallus Gallus)
  misc_feature (36): n=a or c
catgggacaatgtcacctgcatcccctgaactctgncaagaacaggtcccaacaggttcagctccataggg

SEQ ID NO: 46369 - DNA, 71 bp, chicken (Gallus Gallus)
  misc_feature (36): n=a or c
atatcctctatatgttgctgctgtttaggttgtcangagaacctgtggccatcattaatttaattgaatta

SEQ ID NO: 46370 - DNA, 71 bp, chicken (Gallus Gallus)
  misc_feature (36): n=a or g
ctctttgaagatgttccatgaagtctgagcaaaaanataaagcactctgcccaaggtagtgttgatgaaaa

SEQ ID NO: 46371 - DNA, 71 bp, chicken (Gallus Gallus)
  misc_feature (36): n=a or c
tggtgttgttagcccatacagaaaggcagtgagttnagttgtgatacagctccttgaaaagggtgttctcc

SEQ ID NO: 46372 - DNA, 71 bp, chicken (Gallus Gallus)
  misc_feature (36): n=c or t
ctccatacacatctcttcccatccattccatgttanttttgagtttttcccccagaattagttttgttaat

SEQ ID NO: 46373 - DNA, 71 bp, chicken (Gallus Gallus)
  misc_feature (36): n=a or g
atgcgagctgtggaacacaagcagcaactttcaacnaaagcaccaaagctgaactgtttacctcgagacct

SEQ ID NO: 46374 - DNA, 71 bp, chicken (Gallus Gallus)
  misc_feature (36): n=g or t
aactagcttcagccccagatgcattgcacatacctnctgtgtgctgaaatgtcagccctgcatctatctga

SEQ ID NO: 46375 - DNA, 71 bp, chicken (Gallus Gallus)
  misc_feature (36): n=c or t
tcctgagcctgggcagtgtttcgccagcatctgccnttcttttcctcgttccacgaatatctcacccccgc

SEQ ID NO: 46376 - DNA, 71 bp, chicken (Gallus Gallus)
  misc_feature (36): n=a or c
aagttagcattgcttctcagtgagatgttggcaccnagaagtaaagacatatgagtcctctctgggatgta

SEQ ID NO: 46377 - DNA, 71 bp, chicken (Gallus Gallus)
  misc_feature (36): n=a or g
attgcgtgatggaggggtgcgctttggaacgaggtntcctgggccaatttccaactgagtataaaaacagc

SEQ ID NO: 46378 - DNA, 71 bp, chicken (Gallus Gallus)
  misc_feature (36): n=a or g
aagatagcctcagaggagaaaggcacgaggggaagngaaactgcgtctctgtctccttgcagtcacagccc

SEQ ID NO: 46379 - DNA, 71 bp, chicken (Gallus Gallus)
  misc_feature (36): n=c or t
taagttagatcatcgtattttatattagtccataangtcacacaagacttcaaatagcaacatatttgatt

SEQ ID NO: 46380 - DNA, 71 bp, chicken (Gallus Gallus)
  misc_feature (36): n=a or g
gcagagacagaacaagacaagagcattaacactcanaacccagcagggagataggctggcatttcgctcac

SEQ ID NO: 46381 - DNA, 71 bp, chicken (Gallus Gallus)
  misc_feature (36): n=c or t
gcagggtgagctcctgggtgatttttctcatcacanttaatcaggatatttagattgaaagaaaaaaagca

SEQ ID NO: 46382 - DNA, 71 bp, chicken (Gallus Gallus)
  misc_feature (36): n=c or t
tgcctgccagggtattttggcctgctctgtgaattnggtaggtgaaggcttcttacatgctgctcgaattt

SEQ ID NO: 46383 - DNA, 71 bp, chicken (Gallus Gallus)
  misc_feature (36): n=c or t
cctctccttcacatcctgccggctgtgggaaacttncctccgagaaatggctgggtggaaaggcgagcctc

SEQ ID NO: 46384 - DNA, 71 bp, chicken (Gallus Gallus)
  misc_feature (36): n=a or c
gcagcgtgtttggcgtttgtctggtcatgatccccnacatagttaaggaagaaaactccctgctgagcacc

SEQ ID NO: 46385 - DNA, 71 bp, chicken (Gallus Gallus)
  misc_feature (36): n=a or c
gctacagtgacttgataaaaggatattgaagcaagntgaggcatcaaattcaagttaaaatccaaaagcgt

SEQ ID NO: 46386 - DNA, 71 bp, chicken (Gallus Gallus)
  misc_feature (36): n=c or t
tgtctcctggacaccttcctggctgcatcccatccnacttgctgtccagagactcaccattatgacccctg

SEQ ID NO: 46387 - DNA, 71 bp, chicken (Gallus Gallus)
  misc_feature (36): n=c or t
aattgtaggccaggtccctgccaagcctgatgccangcaagcattgaaccacaaactcctggcaggcagaa

SEQ ID NO: 46388 - DNA, 71 bp, chicken (Gallus Gallus)
  misc_feature (36): n=a or g
tacgtttctggccctgaaacaacagtgggagcacantgagaaaggagagctgtgtgtccttctgttttatt

SEQ ID NO: 46389 - DNA, 71 bp, chicken (Gallus Gallus)
  misc_feature (36): n=c or t
acttcagaccttagggtatcatgtagaatttggctngtaggagctcatgtgtaggaatacagcagggctgc

SEQ ID NO: 46390 - DNA, 71 bp, chicken (Gallus Gallus)
  misc_feature (36): n=c or t
ggctttcagaaaacatatgcccttccaagcgttttnattggaagtagaattttatgatgcaaatgagctca

SEQ ID NO: 46391 - DNA, 71 bp, chicken (Gallus Gallus)
  misc_feature (36): n=g or t
acagagacatcacgtttcgtatgggcaggacttcantatgcacacccatgtggattgcactgctcctccac

SEQ ID NO: 46392 - DNA, 71 bp, chicken (Gallus Gallus)
  misc_feature (36): n=a or g
ctttaatgaaacccgatgaatcacaaatgcacagantgtatatcccagagccattaaaggcatagcagata

SEQ ID NO: 46393 - DNA, 71 bp, chicken (Gallus Gallus)
  misc_feature (36): n=a or g
tgtcacaacctgaatcagagcaactttggttgcagngatctggcagcactcacaatggcagtacgcttctg

SEQ ID NO: 46394 - DNA, 71 bp, chicken (Gallus Gallus)
  misc_feature (36): n=c or t
caactgtgcaaccagcgagctacgtgtatgtcaccngtagttacatttagagattggttttgtttattttc

SEQ ID NO: 46395 - DNA, 71 bp, chicken (Gallus Gallus)
  misc_feature (36): n=a or g
gatgacttcaacacagtagagtctactcaaaaaatngaaagataaaggaaattacatacgtaaataagcaa

SEQ ID NO: 46396 - DNA, 71 bp, chicken (Gallus Gallus)
  misc_feature (36): n=a or g
aaattggtctagaaaacttgctgaacttgaagaaantacacaaaaggcaaaatcctagtgtttgaaccttc

SEQ ID NO: 46397 - DNA, 71 bp, chicken (Gallus Gallus)
  misc_feature (36): n=a or g
gctcttgttttttttggtggcagaggaagaggaagnttggatgattttcggtttatggcaacttctatggc

SEQ ID NO: 46398 - DNA, 71 bp, chicken (Gallus Gallus)
  misc_feature (36): n=c or t
cagatatgcactaacggtgcaacgaatttgtaaaangtgcatagagaatttctagaatgccactgctgttt

SEQ ID NO: 46399 - DNA, 71 bp, chicken (Gallus Gallus)
  misc_feature (36): n=c or t
caattctatgctaaccttgttataataaagcaatanttttcacatgatttatctgtacagaaactgtatga

SEQ ID NO: 46400 - DNA, 71 bp, chicken (Gallus Gallus)
  misc_feature (36): n=g or t
atgctgacaccacaggttcattttgctaggagtagnagagggatttcaatcagtatcacagttccattgtt

SEQ ID NO: 46401 - DNA, 71 bp, chicken (Gallus Gallus)
  misc_feature (36): n=a or g
agaaatgcaaacgcttgaaagtaaatctgtattgcnttcaaactatgtcacagaagggttcctcatactgc

SEQ ID NO: 46402 - DNA, 71 bp, chicken (Gallus Gallus)
  misc_feature (36): n=c or t
gcagtgttaaagattcaaatagttctgtgatgtaangtagacagtagcaaagtacagtgattggaatgcag

SEQ ID NO: 46403 - DNA, 71 bp, chicken (Gallus Gallus)
  misc_feature (36): n=a or g
ttacaaccttatttcagatctaatggtttagaaaantaattgtcaacaataaagacttactgagctacatt

SEQ ID NO: 46404 - DNA, 71 bp, chicken (Gallus Gallus)
  misc_feature (36): n=g or t
gttggagggaattcaaaggatccgaatgaccattantgtggtttttatggtaaagtgacatgagtattttt

SEQ ID NO: 46405 - DNA, 71 bp, chicken (Gallus Gallus)
  misc_feature (36): n=a or g
ggtagataaccccaaacatatctgcagcatctgganaacttttaagttttgggtttgtgtgacttcaagtt

SEQ ID NO: 46406 - DNA, 71 bp, chicken (Gallus Gallus)
  misc_feature (36): n=a or g
gctataaaatcaattacatttatgatttctctttanatgttactgtgcttaaacaaagtaattcaggaagt

SEQ ID NO: 46407 - DNA, 71 bp, chicken (Gallus Gallus)
  misc_feature (36): n=a or g
tatttaaaatcaggttgccttgtgtaggatctcagnctggtcactggggagtgatctctgtacctctttag

SEQ ID NO: 46408 - DNA, 71 bp, chicken (Gallus Gallus)
  misc_feature (36): n=c or t
actctgtattaatgttaaagtctagggttttattanagtagtaaaagaatcatcttttaaaattactgtaa

SEQ ID NO: 46409 - DNA, 71 bp, chicken (Gallus Gallus)
  misc_feature (36): n=c or t
attttaaattgtcttgtataattttttgtcccttgngtgagggagtttactatgcataaaactgaggtact

SEQ ID NO: 46410 - DNA, 71 bp, chicken (Gallus Gallus)
  misc_feature (36): n=a or c
acaccaaacaaatggtttcagtaatactgtgacttntcagtggcaatatgcaaggctccaggactctatcc

SEQ ID NO: 46411 - DNA, 71 bp, chicken (Gallus Gallus)
  misc_feature (36): n=c or t
gatgaaaactgaaggctgcttcatcaaccaaactgntgtatttcaactgccctatcaaaccatgcaaatct

SEQ ID NO: 46412 - DNA, 71 bp, chicken (Gallus Gallus)
  misc_feature (36): n=a or c
tacaacaaacctggcaataggtaggacagcaaaaanaaaaatgcaggcagacagaactttacaactttatg

SEQ ID NO: 46413 - DNA, 71 bp, chicken (Gallus Gallus)
  misc_feature (36): n=a or c
acagtgcaaaccattttaaaagactccgaattcccncaggttttcaaagctatgtcagtctctcagctgtg

SEQ ID NO: 46414 - DNA, 71 bp, chicken (Gallus Gallus)
  misc_feature (36): n=c or t
ttccatatatcttctgagttcacgtgtttaaagctngtatgttttaaggtcttttttgctatgttggaaac

SEQ ID NO: 46415 - DNA, 71 bp, chicken (Gallus Gallus)
  misc_feature (36): n=c or t
tcgggaaatagcacatactccaaacatgtaagacangttcctgagtgataagacatcaaactttactagtg

SEQ ID NO: 46416 - DNA, 71 bp, chicken (Gallus Gallus)
  misc_feature (36): n=a or g
aagcatttacagttacttctaattgcaaaccaattntctcatctttaaatttaacatccaagctgcacatg

SEQ ID NO: 46417 - DNA, 71 bp, chicken (Gallus Gallus)
  misc_feature (36): n=g or t
agcaaatccaaggctctcctttacagaaggaaattnaaatgcatataaacctacttcaaagacagtccgta

SEQ ID NO: 46418 - DNA, 71 bp, chicken (Gallus Gallus)
  misc_feature (36): n=c or t
ggcttttcatacctgccaactccaaaaatcccattnctcccaaattaatttcgcatcccttttcaggaatg

SEQ ID NO: 46419 - DNA, 71 bp, chicken (Gallus Gallus)
  misc_feature (36): n=c or t
taaattgttaaagtaaatagtatgacttctaactanccagacagacagcaactatttgggcttgcatcagg

SEQ ID NO: 46420 - DNA, 71 bp, chicken (Gallus Gallus)
  misc_feature (36): n=a or g
tgcttttgcaccatacccagaccaatgattttgacnttactgaaagactcctaaagatatgatgagactca

SEQ ID NO: 46421 - DNA, 71 bp, chicken (Gallus Gallus)
  misc_feature (36): n=a or g
gctgcacttgacacaatctggacttcatctgcaccnaaactgagtctttcaccatttgtttgataagctcg

SEQ ID NO: 46422 - DNA, 71 bp, chicken (Gallus Gallus)
  misc_feature (36): n=g or t
aaagagctctcctggggtctacttaactataattcnagggcacaaaagtttcagtaagtgtattttctggt

SEQ ID NO: 46423 - DNA, 71 bp, chicken (Gallus Gallus)
  misc_feature (36): n=c or t
ttgattattcatgtacctaccttgggatttaaatanctaacttcagggtttgaaaactgtaataactgttt

SEQ ID NO: 46424 - DNA, 71 bp, chicken (Gallus Gallus)
  misc_feature (36): n=a or g
aggctgcttggatgcctcagcatttgcccttgagtntaagctatttcttccacacacaaaaattgcttgaa

SEQ ID NO: 46425 - DNA, 71 bp, chicken (Gallus Gallus)
  misc_feature (36): n=c or t
tctcccacccagtcctgagctcccgatgctgtagantgaccctgcagccttgcatacagatcctcacaggg

SEQ ID NO: 46426 - DNA, 71 bp, chicken (Gallus Gallus)
  misc_feature (36): n=a or c
ttccaacccaaaccactgcgtgattatctcaaaaanaagaagcccagaacaaagcatgtcttatattagaa

SEQ ID NO: 46427 - DNA, 71 bp, chicken (Gallus Gallus)
  misc_feature (36): n=a or c
ttttctttgaatgctataattacattcagatgtgangtgtgaagtgccttgacagtgctgcaacaactttt

SEQ ID NO: 46428 - DNA, 71 bp, chicken (Gallus Gallus)
  misc_feature (36): n=a or g
ttagtagattatcccttgctaactggctaaataacnaacaagaaaatgtgaattcctgttaggctatgtac

SEQ ID NO: 46429 - DNA, 71 bp, chicken (Gallus Gallus)
  misc_feature (36): n=a or g
aaaaacttgctaaattggtgttaatattgcattttnctgcagtcagggatcagtcaggaagcaatgcactt

SEQ ID NO: 46430 - DNA, 71 bp, chicken (Gallus Gallus)
  misc_feature (36): n=a or c
tgtaagcaacagtgcagtttatgcaacggcataaantccctttttcgggctgtatatgagaaatggtttcc

SEQ ID NO: 46431 - DNA, 71 bp, chicken (Gallus Gallus)
  misc_feature (36): n=a or g
tatattgtgtttgctaagtgatgtgtccagccagcncgtgactgtacatttaggaaaactccctcagcatg

SEQ ID NO: 46432 - DNA, 71 bp, chicken (Gallus Gallus)
  misc_feature (36): n=c or t
ttggttaatggccaagattaaattttggatcacaangtggttatttttatctgacagaatcctggtcagta

SEQ ID NO: 46433 - DNA, 71 bp, chicken (Gallus Gallus)
  misc_feature (36): n=a or g
atctctatatactgcacacaaaaaatgcctgggganccttggtaatgaatacatcaacttttaccctgctc

SEQ ID NO: 46434 - DNA, 71 bp, chicken (Gallus Gallus)
  misc_feature (36): n=a or g
gttctgaatgagaaggtgggagaggggacagaaagngcttttgttccacaccaaaatgaaattaaacataa

SEQ ID NO: 46435 - DNA, 71 bp, chicken (Gallus Gallus)
  misc_feature (36): n=g or t
actccttgggggaaacagttgactaaacttttgcancagggtaatctggagtgttttgcatgctgctttca

SEQ ID NO: 46436 - DNA, 71 bp, chicken (Gallus Gallus)
  misc_feature (36): n=a or g
atcagtgcctagatgaaagctcctgctgcaagagcngctgagcaaggattgcttctctgtgctcaacttca

SEQ ID NO: 46437 - DNA, 71 bp, chicken (Gallus Gallus)
  misc_feature (36): n=c or t
agaagacagtcatttaatttacagctgccacacagntagtttactgttacaacattgtctttatgatccat

SEQ ID NO: 46438 - DNA, 71 bp, chicken (Gallus Gallus)
  misc_feature (36): n=a or g
gttgtgaactatgtaaagcatgcttctgcagacctnaatgctagatctcagtggcgataaacccattggca

SEQ ID NO: 46439 - DNA, 71 bp, chicken (Gallus Gallus)
  misc_feature (36): n=a or g
caatgcagtagtttgctaaagatatttgaacttgcnttgcccaggatgtaatacaagattgtttaagttgg

SEQ ID NO: 46440 - DNA, 71 bp, chicken (Gallus Gallus)
  misc_feature (36): n=c or t
ggaagatgtcactcaagttgattccattgccagcgntttaagcatggtagcaaatcagttctgcaacctgc

SEQ ID NO: 46441 - DNA, 71 bp, chicken (Gallus Gallus)
  misc_feature (36): n=a or g
gtgaattctgcaggaaactcgcggatattttgttanaacgcagccctgaccattgcaagcgtaagtgccaa

SEQ ID NO: 46442 - DNA, 71 bp, chicken (Gallus Gallus)
  misc_feature (36): n=a or c
tgtgcaccggtcaacttcataacaagaaaaataggnaacgcatacagcatcgcgatgccgctccgctccca

SEQ ID NO: 46443 - DNA, 71 bp, chicken (Gallus Gallus)
  misc_feature (36): n=g or t
cagcccgacaactcgctgagctctttttgatagggnttgtacggaacagctggttaaattgcttcctttcc

SEQ ID NO: 46444 - DNA, 71 bp, chicken (Gallus Gallus)
  misc_feature (36): n=a or g
gcaaagatctcagcgcagcgcccagggaagaaagcngagcctgtgaagaaagcgagagaaaaatcaatatt

SEQ ID NO: 46445 - DNA, 71 bp, chicken (Gallus Gallus)
  misc_feature (36): n=c or t
tgaccttcacctttagctggtattatcttttcatanctagggagatttatcctagaatcaagatagaaata

SEQ ID NO: 46446 - DNA, 71 bp, chicken (Gallus Gallus)
  misc_feature (36): n=a or g
gattaaatagtttattgatctttatcttatggaaanaaaaaacacaaccaaccatccttagggtgtgagcc

SEQ ID NO: 46447 - DNA, 71 bp, chicken (Gallus Gallus)
  misc_feature (36): n=g or t
gatgtagcgatgtcccattaagaccactggtaaatntatgatgtaaacattcacccaaagctcaaacactg

SEQ ID NO: 46448 - DNA, 71 bp, chicken (Gallus Gallus)
  misc_feature (36): n=a or g
tatctttcagggagtgttgtgagcagtagaaatgtnggtagactacactggagtccagtttaattagtttg

SEQ ID NO: 46449 - DNA, 71 bp, chicken (Gallus Gallus)
  misc_feature (36): n=c or t
agtcaacaaatcacattcaattgctcctgcaattgngaactcaatggtacacattacagaagaaaattgca

SEQ ID NO: 46450 - DNA, 71 bp, chicken (Gallus Gallus)
  misc_feature (36): n=a or g
gacagtgcttggaagctcactgcaactcaacagatngaatatgcatcatgacatccagacatgctgcttcc

SEQ ID NO: 46451 - DNA, 71 bp, chicken (Gallus Gallus)
  misc_feature (36): n=c or t
gaggatggaaagcagagggaaggagacacggtgctnattcaggtagtgcagatggcccttctagtaaatca

SEQ ID NO: 46452 - DNA, 71 bp, chicken (Gallus Gallus)
  misc_feature (36): n=c or t
ctgccctccaattaccacagtttgaagttcacaatngcagtgatctgaaatgaactatttcttttagctca

SEQ ID NO: 46453 - DNA, 71 bp, chicken (Gallus Gallus)
  misc_feature (36): n=a or c
agaatatgtttttcatcttttagaattttacactanaacatctctaaaaatcctcttagagaattatgacc

SEQ ID NO: 46454 - DNA, 71 bp, chicken (Gallus Gallus)
  misc_feature (36): n=a or g
taacatcactgaaaataacagtgttaagggtcagcntcacttacctggtgtcagaggctcccttgctgagt

SEQ ID NO: 46455 - DNA, 71 bp, chicken (Gallus Gallus)
  misc_feature (36): n=a or g
ttacacaccataacacccctagagcatgaactcagncaagtgacattaatcaccatattaaaatacccttc

SEQ ID NO: 46456 - DNA, 71 bp, chicken (Gallus Gallus)
  misc_feature (36): n=c or t
cacatttccactacactcatgtaaaaggcaaccaangcctaacgtgagttgtgagctttgaaacaggtgga

SEQ ID NO: 46457 - DNA, 71 bp, chicken (Gallus Gallus)
  misc_feature (36): n=a or g
ttgctgcacttcccaagttgctctcaattgtgccancagcttttttgagtcaattttcctcacctttaatt

SEQ ID NO: 46458 - DNA, 71 bp, chicken (Gallus Gallus)
  misc_feature (36): n=a or g
gaaacgtggaattaatcttcctattcccttcatatngctctaaatcacatatcctgatctgaatgtatctg

SEQ ID NO: 46459 - DNA, 71 bp, chicken (Gallus Gallus)
  misc_feature (36): n=c or t
ggaacctgagcttttgtagcaagaattcatttgagncatggtgcttctccaggcacctgactaaaatggag

SEQ ID NO: 46460 - DNA, 71 bp, chicken (Gallus Gallus)
  misc_feature (36): n=g or t
aaaaacaggcggcctgtaagatagcagactgccatntgtagcgaggctgcttggctttcggggttgtttga

SEQ ID NO: 46461 - DNA, 71 bp, chicken (Gallus Gallus)
  misc_feature (36): n=a or g
ggggtaattaacctgtcctaaaaactcagggcaagntgctggagttgaacaaaatacagaagtgctgaggg

SEQ ID NO: 46462 - DNA, 71 bp, chicken (Gallus Gallus)
  misc_feature (36): n=c or t
tgcctctttctttcctaactgcaactatgaagcagnattttgcattgccacctgctgctaaagacaggcac

SEQ ID NO: 46463 - DNA, 71 bp, chicken (Gallus Gallus)
  misc_feature (36): n=c or t
atcagtacagtttctttctgttacaggctaatgtcnagtatggacacgtcagttgtcatgtttcttctagg

SEQ ID NO: 46464 - DNA, 71 bp, chicken (Gallus Gallus)
  misc_feature (36): n=c or t
atcatgccaaattgaacaaggtgatagtgaaacttngtgcaactggtgaaactgatgaggcaaggattaat

SEQ ID NO: 46465 - DNA, 71 bp, chicken (Gallus Gallus)
  misc_feature (36): n=a or g
caaatgtgatgtcctgaggcttactgcaagagacantgcaacccatgtgaacaagatgtcaaggtccttct

SEQ ID NO: 46466 - DNA, 71 bp, chicken (Gallus Gallus)
  misc_feature (36): n=a or g
gtgatccacatggacatcccagccctgacaacagangtctgtctgttacccttttctattaggtcaaatgg

SEQ ID NO: 46467 - DNA, 71 bp, chicken (Gallus Gallus)
  misc_feature (36): n=c or t
gtcagtttctatcaacaaaaggtagtcttgctttcngtgtcactgctgcggaattgtaataagggaaacgg

SEQ ID NO: 46468 - DNA, 71 bp, chicken (Gallus Gallus)
  misc_feature (36): n=c or t
gaggtgaccatgagcctacctggtacctatccatanggtgcagagtgaatacacctgacaagtcaggctct

SEQ ID NO: 46469 - DNA, 71 bp, chicken (Gallus Gallus)
  misc_feature (36): n=c or t
tcaacctgcagaaagtcatactcaaaatagttgtgntataaatgatgaaagactggatattaccttcagag

SEQ ID NO: 46470 - DNA, 71 bp, chicken (Gallus Gallus)
  misc_feature (36): n=g or t
ctctccttgccaagagattctgtgtgtcagttcttnttctcatcatatccagtttagatctttctgcattg

SEQ ID NO: 46471 - DNA, 71 bp, chicken (Gallus Gallus)
  misc_feature (36): n=a or g
ctgggtctctcatcacatacatgaagattgttgacncagcacatctttccagatgaaagaagacctctgct

SEQ ID NO: 46472 - DNA, 71 bp, chicken (Gallus Gallus)
  misc_feature (36): n=a or g
gccaaagggcttactgaaagcgcttggtgccaacanatctgctttttcgggagggtggcttggaggggcga

SEQ ID NO: 46473 - DNA, 71 bp, chicken (Gallus Gallus)
  misc_feature (36): n=a or g
gtttctgtagcaaccactccacagtgatgcaactcnatttgacatcaaagaataaatgtatcaagtcatcc

SEQ ID NO: 46474 - DNA, 71 bp, chicken (Gallus Gallus)
  misc_feature (36): n=c or t
ttcttactgagaagtaagatctttgaaaaagaattnagacagggacactgaaagtacatcctgtccatccc

SEQ ID NO: 46475 - DNA, 71 bp, chicken (Gallus Gallus)
  misc_feature (36): n=a or g
aaaatgagttttctgccttaggaagacttcactttnagcacttaagcattacaagcatttgcttgtaggga

SEQ ID NO: 46476 - DNA, 71 bp, chicken (Gallus Gallus)
  misc_feature (36): n=a or g
gaattgtctcttaaatatagccactgtgactgaagngcttttcaagcttgttaaaatatgactaatttata

SEQ ID NO: 46477 - DNA, 71 bp, chicken (Gallus Gallus)
  misc_feature (36): n=c or t
attagtgaggtaaacgaagggaaggaatatgcacangctgttatacaaaattatgcaggacaatattaaaa

SEQ ID NO: 46478 - DNA, 71 bp, chicken (Gallus Gallus)
  misc_feature (36): n=a or g
atcaaatctttaacacaggaagagatttcagagatnaaatgaatggttcgatgctgtttttctagtgttca

SEQ ID NO: 46479 - DNA, 71 bp, chicken (Gallus Gallus)
  misc_feature (36): n=g or t
tgcatgcgtgcttcttcttacagatgcattgtctgngaaggacctgcaatggtaatagcagttcacagcca

SEQ ID NO: 46480 - DNA, 71 bp, chicken (Gallus Gallus)
  misc_feature (36): n=a or g
gcgtagtagatataacagtgctgcagaagttgtgcngccaggggtagattttaaattacattagcaatatg

SEQ ID NO: 46481 - DNA, 71 bp, chicken (Gallus Gallus)
  misc_feature (36): n=c or t
ttaagatgcataactacagttggaagcaaagttaanttcttcagtgcaggtttcttttgtgtattcagctg

SEQ ID NO: 46482 - DNA, 71 bp, chicken (Gallus Gallus)
  misc_feature (36): n=a or g
ttttttttgttccgttagtgttacttgtagcattcngggggaacatgacagacctgtggacagaggggcaa

SEQ ID NO: 46483 - DNA, 71 bp, chicken (Gallus Gallus)
  misc_feature (36): n=a or g
tgacatgcttatactacattggtatacttctcatanggatggttgtgtctgtcaaattagtaactgtaagc

SEQ ID NO: 46484 - DNA, 71 bp, chicken (Gallus Gallus)
  misc_feature (36): n=g or t
ctgttgcattttctttgttgaattaaatgtaacagntcaacctcctcctgctcgtgaaaggctgggaaagt

SEQ ID NO: 46485 - DNA, 71 bp, chicken (Gallus Gallus)
  misc_feature (36): n=c or t
gggtgtgcttagtgccaaagacacttctagatcttntgcagaggtgctgataattggtcagttactttcaa

SEQ ID NO: 46486 - DNA, 71 bp, chicken (Gallus Gallus)
  misc_feature (36): n=a or g
atttttcttaggatggtactttggctcaggaaaacngagattttgagaatctgtgttggcagaaagaacta

SEQ ID NO: 46487 - DNA, 71 bp, chicken (Gallus Gallus)
  misc_feature (36): n=a or c
aattactttagatactgaagttttgttgtgattttntgcattagggagcttttgtaaaagtaaatcatttt

SEQ ID NO: 46488 - DNA, 71 bp, chicken (Gallus Gallus)
  misc_feature (36): n=c or t
acataaatgaaaaataaaaactgcagttaaggtaanttttcataggcaaactggaaattgtgggattaatc

SEQ ID NO: 46489 - DNA, 71 bp, chicken (Gallus Gallus)
  misc_feature (36): n=a or g
agttcagtgaggttcatgatctttgcagccacttcntttgcaaatatattgacagaatctggtgtgtcctc

SEQ ID NO: 46490 - DNA, 71 bp, chicken (Gallus Gallus)
  misc_feature (36): n=a or g
catcatactaaatagttcagcaaagtacagattaangagctggcaatgaggagctgaatggcaggtaaatg

SEQ ID NO: 46491 - DNA, 71 bp, chicken (Gallus Gallus)
  misc_feature (36): n=a or c
tatagccataaactatggcctaaaataaagaacagncaccaaagacttgtgcaaaaatcctcttagaaaac

SEQ ID NO: 46492 - DNA, 71 bp, chicken (Gallus Gallus)
  misc_feature (36): n=a or g
gcaatatctgcttacaaagtgctgtcacgattcagncccaggactttgccagatgtttgagatgttttgat

SEQ ID NO: 46493 - DNA, 71 bp, chicken (Gallus Gallus)
  misc_feature (36): n=a or g
tcttgtttggaagtcggtccggctgctttttcctcntggaaaggttcttgattgactgtgtgggatttgtt

SEQ ID NO: 46494 - DNA, 71 bp, chicken (Gallus Gallus)
  misc_feature (36): n=g or t
actttgagcaattggttggacaagacttctagcctntattatcttatgcttctctgattccaatattccta

SEQ ID NO: 46495 - DNA, 71 bp, chicken (Gallus Gallus)
  misc_feature (36): n=a or g
gtagtcagtacctcttgtaaccaggaatttgctcanggagcagcctggagggatgggcatgaaacaagagg

SEQ ID NO: 46496 - DNA, 71 bp, chicken (Gallus Gallus)
  misc_feature (36): n=a or g
ttcactactagatctacattgaggcatcaattctanagttgtcatttacaccactgagagacttaattgtt

SEQ ID NO: 46497 - DNA, 71 bp, chicken (Gallus Gallus)
  misc_feature (36): n=a or c
ccattgatttttgtaataaattattaaggaaattcncaagcagtgttaaagcacatggtggaacacataac

SEQ ID NO: 46498 - DNA, 71 bp, chicken (Gallus Gallus)
  misc_feature (36): n=c or t
cttacagttgtaccagatggagaaggaaggagacangatcattctgaagtggctttttaggaaacgcatgg

SEQ ID NO: 46499 - DNA, 71 bp, chicken (Gallus Gallus)
  misc_feature (36): n=c or t
ggactgctgaaggtacacatttgtttcagtaacagngatcttggcagacgagggaggcagctccagcaggc

SEQ ID NO: 46500 - DNA, 71 bp, chicken (Gallus Gallus)
  misc_feature (36): n=c or t
gcattgtataaaggagcagcattacttgcaaagtantgatctgctcttggccttaaaaaatatcaagtgaa

SEQ ID NO: 46501 - DNA, 71 bp, chicken (Gallus Gallus)
  misc_feature (36): n=c or t
tgataaaaagcactaaatttgttactaaaagaaaanatagttaaatggctcttttgattgctaagtgagtc

SEQ ID NO: 46502 - DNA, 71 bp, chicken (Gallus Gallus)
  misc_feature (36): n=a or g
aacatcactgcctctaaggtttaaggcaccatattnccatctaaccagaaatttcgcacttaacaatgcaa

SEQ ID NO: 46503 - DNA, 71 bp, chicken (Gallus Gallus)
  misc_feature (36): n=c or t
gctgcctccaacaccaacccccttcataccggcatnttctaggaaacaaatattctagcaaactaaccaaa

SEQ ID NO: 46504 - DNA, 71 bp, chicken (Gallus Gallus)
  misc_feature (36): n=a or g
catctcctccggaaaccgttggcaaatgctgacatntaacagcagccaatggtttgggggttttttttgtt

SEQ ID NO: 46505 - DNA, 71 bp, chicken (Gallus Gallus)
  misc_feature (36): n=a or g
gcagcaaacacagcatccttgcactgatgaaggatntaaaccaacctatatcaatatgaactcgctgatat

SEQ ID NO: 46506 - DNA, 71 bp, chicken (Gallus Gallus)
  misc_feature (36): n=a or g
atctggaaccaataacgtgtgctctctatctcaacntggtgtaagaaataagctgaccttaggacactgaa

SEQ ID NO: 46507 - DNA, 71 bp, chicken (Gallus Gallus)
  misc_feature (36): n=a or c
aaaatgaggacaaagacaagtacattacaataatanagggctgtcagaagatgaaaacaacctgtgggtct

SEQ ID NO: 46508 - DNA, 71 bp, chicken (Gallus Gallus)
  misc_feature (36): n=c or t
tttatataaggacactaatgctacttaaaatatagnaattgctctgccacacatggaaacctaaagtactg

SEQ ID NO: 46509 - DNA, 71 bp, chicken (Gallus Gallus)
  misc_feature (36): n=c or t
agagagctacagacaggtgaaggtcagtaactaaancagctagactgaggtagcttgagatttataggaca

SEQ ID NO: 46510 - DNA, 71 bp, chicken (Gallus Gallus)
  misc_feature (36): n=a or g
ttctccaacctccttttacaacatacttcagttgangaagctcctgtgtttactacagtcagaacacagag

SEQ ID NO: 46511 - DNA, 71 bp, chicken (Gallus Gallus)
  misc_feature (36): n=g or t
ggatctctgcaggaatgttagaattgtacaaaatanttgatttcttccacccaaaacacgcatctggatac

SEQ ID NO: 46512 - DNA, 71 bp, chicken (Gallus Gallus)
  misc_feature (36): n=g or t
tacatggtgtgtgtggacattttctaccacagttanctggctctgatagcatcacgttagtcagaacaatg

SEQ ID NO: 46513 - DNA, 71 bp, chicken (Gallus Gallus)
  misc_feature (36): n=a or c
cagatgttcaggtacttctattgaaaactacttttnaaatgaaggcttgaaatggattatgcagtcctgta

SEQ ID NO: 46514 - DNA, 71 bp, chicken (Gallus Gallus)
  misc_feature (36): n=c or t
gggagcagagcagagagaattaagaacaattaaacnaaagaatgttgcttgaatgggattccttaatcttc

SEQ ID NO: 46515 - DNA, 71 bp, chicken (Gallus Gallus)
  misc_feature (36): n=a or g
gacttgccgttggcagcttcctggctgaactctgcntcctctttgcaaaacctggctcttggatctccttg

SEQ ID NO: 46516 - DNA, 71 bp, chicken (Gallus Gallus)
  misc_feature (36): n=a or c
gatattttttagctgactgaatgtgaacttagtagnattgtggcattccttcctgactacccaaattctca

SEQ ID NO: 46517 - DNA, 71 bp, chicken (Gallus Gallus)
  misc_feature (36): n=a or g
ccccagaccaggtccccaggaagcaatctgtgcccngcagtgagaccgagctgagctctgagcccctccaa

SEQ ID NO: 46518 - DNA, 71 bp, chicken (Gallus Gallus)
  misc_feature (36): n=c or t
gattaaatatttttttgaaggcatgctgttaatcangtatctgttactgacaaagcaaacatctacaactc

SEQ ID NO: 46519 - DNA, 71 bp, chicken (Gallus Gallus)
  misc_feature (36): n=a or g
gaagcataaggactgccctggtacacaacctaaagngaccacaacaatcacaaaaggcaaggaattattaa

SEQ ID NO: 46520 - DNA, 71 bp, chicken (Gallus Gallus)
  misc_feature (36): n=a or g
tctgctgttaacttgcataactttaatgagaatgtnaaacagatatgaattactcttatttggaaatttca

SEQ ID NO: 46521 - DNA, 71 bp, chicken (Gallus Gallus)
  misc_feature (36): n=a or g
ttatgttagaccaaccacagtccttttcagtacttnaattccaatgcattcctcttcatatgtgtccaggg

SEQ ID NO: 46522 - DNA, 71 bp, chicken (Gallus Gallus)
  misc_feature (36): n=a or g
caccattgggcttgttttctcccagaatgaaacagnggcagttaaataatccaaagtcacaggcaggagtc

SEQ ID NO: 46523 - DNA, 71 bp, chicken (Gallus Gallus)
  misc_feature (36): n=c or t
cagttctgtactgctaacttgctgcagctacaaaangacagcactccgcatttattactactgttattttg

SEQ ID NO: 46524 - DNA, 71 bp, chicken (Gallus Gallus)
  misc_feature (36): n=c or t
cactgacttgggagagagctaccatcaggctgggcntccattgtcctaatgtagctttgaggatatttttg

SEQ ID NO: 46525 - DNA, 71 bp, chicken (Gallus Gallus)
  misc_feature (36): n=c or t
ctttgcagtttttgattacatgagttgctgtgaaantcactgacttaaatttctccaagttggttccagcc

SEQ ID NO: 46526 - DNA, 71 bp, chicken (Gallus Gallus)
  misc_feature (36): n=a or g
tcccaactctttggtcatttcatttaaggcttagcntagattaaatcaagatcttgtgcgttgcttttatg

SEQ ID NO: 46527 - DNA, 71 bp, chicken (Gallus Gallus)
  misc_feature (36): n=a or g
gctaagatccatctgttgatagatagagcttggaanatcttttgggaacttcctgtgtcaagactgtagaa

SEQ ID NO: 46528 - DNA, 71 bp, chicken (Gallus Gallus)
  misc_feature (36): n=a or c
ctcactgaggagcatcatgagcagagacctcttctncagggctgcagagcaaggtgggacgccggcataca

SEQ ID NO: 46529 - DNA, 71 bp, chicken (Gallus Gallus)
  misc_feature (36): n=a or g
ccacaagccctttttcagttatctggttctgagcanatacatccttgatagaaagatcattatttgcagta

SEQ ID NO: 46530 - DNA, 71 bp, chicken (Gallus Gallus)
  misc_feature (36): n=c or t
ctaacagaacaaaatccattgttttactaaaaaagnctttacatccagtcaactgtttattgtcatccatg

SEQ ID NO: 46531 - DNA, 71 bp, chicken (Gallus Gallus)
  misc_feature (36): n=c or t
tgcaaaatgcctgaacttctttatctaacatgaaanatcctatacacaggatttttcagtaagacaaatga

SEQ ID NO: 46532 - DNA, 71 bp, chicken (Gallus Gallus)
  misc_feature (36): n=a or g
attactgggagggaacataaacattgtctggcagtncgttctacataaaattctccaaggtagaaaaatgc

SEQ ID NO: 46533 - DNA, 71 bp, chicken (Gallus Gallus)
  misc_feature (36): n=a or g
taaaaatgagaatcaagtggttacggggagctcacnttgcaaagtaactactctgaaagcagatttatttg

SEQ ID NO: 46534 - DNA, 71 bp, chicken (Gallus Gallus)
  misc_feature (36): n=c or t
gcttctgtgagtctgctctgatggaggagcgctcanttgctcaagctggaggtaaagttcgttgctttagg

SEQ ID NO: 46535 - DNA, 71 bp, chicken (Gallus Gallus)
  misc_feature (36): n=c or t
agtatgaactccataacaataggaagagtagaaagnacttttagaacatgccatgcaattgctaaatctgt

SEQ ID NO: 46536 - DNA, 71 bp, chicken (Gallus Gallus)
  misc_feature (36): n=c or t
atggacagactaatggccatgcagaaggtgttttcntttttcccactcaagttcttcatgctggtcgttct

SEQ ID NO: 46537 - DNA, 71 bp, chicken (Gallus Gallus)
  misc_feature (36): n=a or g
aaggagaaggagttcgtcatcgtgcgcaggcctcgnctgctccgagaggcagagccaggtactggcaggcg

SEQ ID NO: 46538 - DNA, 71 bp, chicken (Gallus Gallus)
  misc_feature (36): n=a or g
gtcactgaggttgatatatgtggtagttggtaaaancttcctcctgctgtatactcagccagcacccttaa

SEQ ID NO: 46539 - DNA, 71 bp, chicken (Gallus Gallus)
  misc_feature (36): n=c or t
aaacacatgttgcttccacctctagttactgcttangcagatggagatagctactaactagatgcttacgg

SEQ ID NO: 46540 - DNA, 71 bp, chicken (Gallus Gallus)
  misc_feature (36): n=c or t
aagtcaacatataccagatggtagcacagccattanagcatctaaataaatactcaagttactgagttcac

SEQ ID NO: 46541 - DNA, 71 bp, chicken (Gallus Gallus)
  misc_feature (36): n=a or g
tccaagacaacttttggatcaaaaaccccacgcatntgaagacgagagtatggcagtccaagcagcaccag

SEQ ID NO: 46542 - DNA, 71 bp, chicken (Gallus Gallus)
  misc_feature (36): n=c or t
gaagattcagctgtgacattgtcaaaagttgcaagnagttggctactatgcaggtatgctgcttcaggatc

SEQ ID NO: 46543 - DNA, 71 bp, chicken (Gallus Gallus)
  misc_feature (36): n=c or t
ccagcagctcttccttccgctctgaggaaggaactnattaccaccttcaaaataaagtgctaagaaactag

SEQ ID NO: 46544 - DNA, 71 bp, chicken (Gallus Gallus)
  misc_feature (36): n=c or t
tctgtgaaatatagtctaagtgtggtgaagatctgnatcattccactggaaagagggggaatgaaaagcag

SEQ ID NO: 46545 - DNA, 71 bp, chicken (Gallus Gallus)
  misc_feature (36): n=a or g
gtgcctttccgctagaagccccgcggctttctgtgntgaaaatacggtaatgtggtgtactgagccgcaag

SEQ ID NO: 46546 - DNA, 71 bp, chicken (Gallus Gallus)
  misc_feature (36): n=c or t
ttatcacacttaatttgttgcaggatttattctganactgtggactatgaagatgcatgtttgattgttcg

SEQ ID NO: 46547 - DNA, 71 bp, chicken (Gallus Gallus)
  misc_feature (36): n=c or t
aaggctgttgtaaaggatcaagcagtattaaatagnaaaggatttcaggggcataatctcaataccctcag

SEQ ID NO: 46548 - DNA, 71 bp, chicken (Gallus Gallus)
  misc_feature (36): n=c or t
gattcagataacatttcattcatcagagaaagtgcntgtgatactctcatcctgtgatgttcagcatacag

SEQ ID NO: 46549 - DNA, 71 bp, chicken (Gallus Gallus)
  misc_feature (36): n=c or t
attctatcttatcttaggtactttacttgaagaagngtgatatcttggaaaaactgcaagagtatgtgatt

SEQ ID NO: 46550 - DNA, 71 bp, chicken (Gallus Gallus)
  misc_feature (36): n=c or t
aagaaatctaacatcttctgttagcgtccaaatagntgaagctggagactacttccatgcaatgaacagat

SEQ ID NO: 46551 - DNA, 71 bp, chicken (Gallus Gallus)
  misc_feature (36): n=a or g
aactgtagcaaagaagggataaggaaagacagtgcnctctttgaatgattgattttcctacatcgctggct

SEQ ID NO: 46552 - DNA, 71 bp, chicken (Gallus Gallus)
  misc_feature (36): n=a or g
ttttgagtaaacagaggtgcagtgtgtttaggtatnctgcaacctctagcaatgtcctgaaaatgttgtat

SEQ ID NO: 46553 - DNA, 71 bp, chicken (Gallus Gallus)
  misc_feature (36): n=g or t
tcttgtgagtgttttttttttttaatttttcagtgnttcagctcaatgtagttggccttcatttctctctt

SEQ ID NO: 46554 - DNA, 71 bp, chicken (Gallus Gallus)
  misc_feature (36): n=g or t
agaagggtaagaggtgttttgccacattaattattncagtgataaaactctgcagtttataaatgatcttg

SEQ ID NO: 46555 - DNA, 71 bp, chicken (Gallus Gallus)
  misc_feature (36): n=c or t
ttagcgatgatataaatgccatacatttctccaccnggtttgctgaacctgttccttgagcagctgccagt

SEQ ID NO: 46556 - DNA, 71 bp, chicken (Gallus Gallus)
  misc_feature (36): n=a or g
tggagaataccgccctgctaagtaaggtctgggacnaggtggaatatgttccatagaagcaggaagaggta

SEQ ID NO: 46557 - DNA, 71 bp, chicken (Gallus Gallus)
  misc_feature (36): n=a or g
gtgtatcagtcaatggtctcagagataagtggctgncttcttgcaagattcaacacgtttaaaggagctat

SEQ ID NO: 46558 - DNA, 71 bp, chicken (Gallus Gallus)
  misc_feature (36): n=c or t
aggtggtgctaagcatgaccaaggaaggaaagcatntcaatggtcagaaatgaatacagatagaaatgctc

SEQ ID NO: 46559 - DNA, 71 bp, chicken (Gallus Gallus)
  misc_feature (36): n=a or g
tatcaacaaagcctgatgcctcaaatgctgcagacnttgtcaaatatatttgctttcgaataggcttttgc

SEQ ID NO: 46560 - DNA, 71 bp, chicken (Gallus Gallus)
  misc_feature (36): n=c or t
catcattctatgttaggatttagcactgcttcctantgacagatttaattgataagtaatagaaactgcat

SEQ ID NO: 46561 - DNA, 71 bp, chicken (Gallus Gallus)
  misc_feature (36): n=c or t
tggaagaataaatctccaatattttattctgccacngcacaattacgatgtaacttctaagtccacttccc

SEQ ID NO: 46562 - DNA, 71 bp, chicken (Gallus Gallus)
  misc_feature (36): n=a or g
cattcactcactactatcgcatttatacacgagagnaggggtggaggttgggagaaggtattctgatggca

SEQ ID NO: 46563 - DNA, 71 bp, chicken (Gallus Gallus)
  misc_feature (36): n=c or t
ttgatataacactgcagtatgacttgtttggaagcngtgacatcttctgtatctccgtgacataaacattg

SEQ ID NO: 46564 - DNA, 71 bp, chicken (Gallus Gallus)
  misc_feature (36): n=c or t
tctcccatgaccaggtattgaaggatcaagaatttnattgtatggagtattttctagggttcagtttgccc

SEQ ID NO: 46565 - DNA, 71 bp, chicken (Gallus Gallus)
  misc_feature (36): n=c or t
cataaacattagatctctttcactgtcttctccgtntttctattctactttggtatcccagccatccacca

SEQ ID NO: 46566 - DNA, 71 bp, chicken (Gallus Gallus)
  misc_feature (36): n=c or t
cagtgagaatccacaaagaaccttcatgtcctcctnctgcatacagccaactccattatacagtcactaaa

SEQ ID NO: 46567 - DNA, 71 bp, chicken (Gallus Gallus)
  misc_feature (36): n=a or g
ctatgctcttaaagactgcagcttacttcttgtttncataatttagtctgctataatttatctggtgccaa

SEQ ID NO: 46568 - DNA, 71 bp, chicken (Gallus Gallus)
  misc_feature (36): n=a or g
acggctgtggctcaggttacattcctttctcccgcncagccctcaccatttctcaacgtggtaagaagcca

SEQ ID NO: 46569 - DNA, 71 bp, chicken (Gallus Gallus)
  misc_feature (36): n=c or t
actgcaggtttatttctgattaatagtacttatgantgagacatctttagtatgtctaattttttaagatt

SEQ ID NO: 46570 - DNA, 71 bp, chicken (Gallus Gallus)
  misc_feature (36): n=a or g
aaacatttgcaattggcatcagtgcatttaatcacnttaatgttggttttaataatagattatagtcctga

SEQ ID NO: 46571 - DNA, 71 bp, chicken (Gallus Gallus)
  misc_feature (36): n=g or t
tgaaaacgagagtatgatttcagaagtataagcagngctctgagtttctgcagtgtgagggcaatcaaaca

SEQ ID NO: 46572 - DNA, 71 bp, chicken (Gallus Gallus)
  misc_feature (36): n=a or g
ggtacctaactccttccctgtagggattattctgcnaagagtactggtcacactttaaggaatgactattt

SEQ ID NO: 46573 - DNA, 71 bp, chicken (Gallus Gallus)
  misc_feature (36): n=c or t
actgaaaacaaggtttggttgtctctttcctgtttnttccactttgtggatggataaagtaccaagatgtg

SEQ ID NO: 46574 - DNA, 71 bp, chicken (Gallus Gallus)
  misc_feature (36): n=a or g
gtaagcttcctcagcctttcaaaatacttccttgtntcagtaggcaggtctgtctaaacaatttccaagtt

SEQ ID NO: 46575 - DNA, 71 bp, chicken (Gallus Gallus)
  misc_feature (36): n=a or g
tcaatgaaatgaaagggataaaccatccgaggacanatctgcatggggaaattcaaagcctcccccaaacc

SEQ ID NO: 46576 - DNA, 71 bp, chicken (Gallus Gallus)
  misc_feature (36): n=a or g
agcactgcttataaaggattggatcacatgatgtcntgtgtgactgcacatactgtttgaactaagttcct

SEQ ID NO: 46577 - DNA, 71 bp, chicken (Gallus Gallus)
  misc_feature (36): n=c or t
cctccatcttggacctgaaatcccatgtctgatccngtggccttgggctgctctgtagcaaacagcttgca

SEQ ID NO: 46578 - DNA, 71 bp, chicken (Gallus Gallus)
  misc_feature (36): n=g or t
gccgcaagagcagaagtttctatataggcaatgctnctggattgtggaagcagcccccttgctgtactgga

SEQ ID NO: 46579 - DNA, 71 bp, chicken (Gallus Gallus)
  misc_feature (36): n=c or t
ttaattaagaaaaaaacatacctgaaatggataaanggaggactacattaaattagtttatattttctggt

SEQ ID NO: 46580 - DNA, 71 bp, chicken (Gallus Gallus)
  misc_feature (36): n=a or g
ataactcactaaagcagaatatatatttggactgtnttatacatatctaggtgtggatgataggagaacat

SEQ ID NO: 46581 - DNA, 71 bp, chicken (Gallus Gallus)
  misc_feature (36): n=c or t
agtaatgagggaccaatctctttcttttcagattgntttcctcaggtggtggtgtttttgaacactgactt

SEQ ID NO: 46582 - DNA, 71 bp, chicken (Gallus Gallus)
  misc_feature (36): n=c or t
attgtaaattttcctacccatcagtgtgtgtaaganatagcctatcccactcaactctgaccatctgaaac

SEQ ID NO: 46583 - DNA, 71 bp, chicken (Gallus Gallus)
  misc_feature (36): n=c or t
atacttacattgcaaagtcttcttattttataacanattcttcctggtgaccatgaaacaaaatgttggaa

SEQ ID NO: 46584 - DNA, 71 bp, chicken (Gallus Gallus)
  misc_feature (36): n=a or g
ggaagaggaggatgaggtggtattggtggaagcacngattaggaaaagagggtagagcagggcctgcagca

SEQ ID NO: 46585 - DNA, 71 bp, chicken (Gallus Gallus)
  misc_feature (36): n=a or c
aatgaaaacaacagctgggacatttggatgtttaanaaaatcatgatatgacagtaaacaaagctaaaatt

SEQ ID NO: 46586 - DNA, 71 bp, chicken (Gallus Gallus)
  misc_feature (36): n=c or t
catcaaaattctgtgcagtaattgtcagtctaatgnacattcatgcccagattttgaagccaaaacaagaa

SEQ ID NO: 46587 - DNA, 71 bp, chicken (Gallus Gallus)
  misc_feature (36): n=c or t
ctgatctggttagggatgaaaaaccaaagccagatntaacagtggagaaacccactcatttttccttttat

SEQ ID NO: 46588 - DNA, 71 bp, chicken (Gallus Gallus)
  misc_feature (36): n=c or t
tctgcagatatgagcataacagatatgtatcagtgnaccacatcaggctggaacttcttcattgtgaagaa

SEQ ID NO: 46589 - DNA, 71 bp, chicken (Gallus Gallus)
  misc_feature (36): n=a or g
cccagtctgcccagcgggctctcagccagtaagacnatcaggatgcagagcagttaccagagaagagacag

SEQ ID NO: 46590 - DNA, 71 bp, chicken (Gallus Gallus)
  misc_feature (36): n=a or g
tctgatgtagaaaactcatctttaataatgacagtngtactttcgaagcaagttctcatagatggatttac

SEQ ID NO: 46591 - DNA, 71 bp, chicken (Gallus Gallus)
  misc_feature (36): n=c or t
gtttcatgttaaagtacttaggagattcagaaatgngagtttggatactcaggaatgggaagcagtttggt

SEQ ID NO: 46592 - DNA, 71 bp, chicken (Gallus Gallus)
  misc_feature (36): n=g or t
actaaacagtcacttgggaaagctgtcatgaaaaanggttcaattcttctcaaaagtgagccatgttttct

SEQ ID NO: 46593 - DNA, 71 bp, chicken (Gallus Gallus)
  misc_feature (36): n=c or t
taagctaacggcatatttgatatcatttgacagagnagttctcatcccagcaatctctgattttatcagag

SEQ ID NO: 46594 - DNA, 71 bp, chicken (Gallus Gallus)
  misc_feature (36): n=c or t
ttccactggattcagtggaatatgaatcccctgganggagaaccaaggtgatttggttaatggctgatgct

SEQ ID NO: 46595 - DNA, 71 bp, chicken (Gallus Gallus)
  misc_feature (36): n=a or c
tgtagatgtgtcagcataactgttcattatttttanctactctggtaactattttttccagttatccaata

SEQ ID NO: 46596 - DNA, 71 bp, chicken (Gallus Gallus)
  misc_feature (36): n=g or t
acaaacagattgaagtacttagccctccttgctgcnttataaatgaatatttctcccaggaaactgtcatg

SEQ ID NO: 46597 - DNA, 71 bp, chicken (Gallus Gallus)
  misc_feature (36): n=c or t
ctgggagtgttcacttgtaggaatgtttctctgaanaagacaggaagttagaacattatttagttgcctga

SEQ ID NO: 46598 - DNA, 71 bp, chicken (Gallus Gallus)
  misc_feature (36): n=g or t
caactttgtgattttattccagcaatacagaatctnccatgccagggtagcaccctgtctttttcagctgc

SEQ ID NO: 46599 - DNA, 71 bp, chicken (Gallus Gallus)
  misc_feature (36): n=c or t
taataaattatttggattgttcatacctgagtctgngtctcagatgctgcagagcacaagtttcattaaaa

SEQ ID NO: 46600 - DNA, 71 bp, chicken (Gallus Gallus)
  misc_feature (36): n=a or c
cagaggacttctgtaagtgtaactgcactacagacnttttagagagaatctctgtgaagcaggttaaaatg

SEQ ID NO: 46601 - DNA, 71 bp, chicken (Gallus Gallus)
  misc_feature (36): n=a or g
ataggtgttgttaagtttctcagcagcctgaatgtntgatttgacctttttatctggtacacagcagcaga

SEQ ID NO: 46602 - DNA, 71 bp, chicken (Gallus Gallus)
  misc_feature (36): n=g or t
tccattctgacaaaaaaaaagctggatccatccttnaaatttgacctcttatagatgtagtcatctagata

SEQ ID NO: 46603 - DNA, 71 bp, chicken (Gallus Gallus)
  misc_feature (36): n=a or g
gcgatttctattaattagttaatctccagcaaacantcaattacaaaattgtgcttcagggaggaatgcag

SEQ ID NO: 46604 - DNA, 71 bp, chicken (Gallus Gallus)
  misc_feature (36): n=c or t
ttgcaactaagtaaatgtaggccatatgactccccngcattttttaagtgtttagtttgtttttcatgctc

SEQ ID NO: 46605 - DNA, 71 bp, chicken (Gallus Gallus)
  misc_feature (36): n=a or g
tggacaacttcaactcctgcctccaggggtccatcncccataactgggcgtcgtgcatatgttctcctgtg

SEQ ID NO: 46606 - DNA, 71 bp, chicken (Gallus Gallus)
  misc_feature (36): n=c or t
agacaaacagctcatttacccacatccatcaccagngacatacctcatacactccatccttctggagcttt

SEQ ID NO: 46607 - DNA, 71 bp, chicken (Gallus Gallus)
  misc_feature (36): n=c or t
agacttctcatgcaagtcatgcctgtatcacatttngtttatcaccctagtttatcagcaaagctgaacac

SEQ ID NO: 46608 - DNA, 71 bp, chicken (Gallus Gallus)
  misc_feature (36): n=c or t
atgccacaaagaaggcatctttttaaagagttgttnacctgcaaggtgctgttcagatgcttatagataaa

SEQ ID NO: 46609 - DNA, 71 bp, chicken (Gallus Gallus)
  misc_feature (36): n=c or t
tgtgccttcaagaaggactgagataatgccaagcantgggtaggattaatctgttgtcaggttgatttaag

SEQ ID NO: 46610 - DNA, 71 bp, chicken (Gallus Gallus)
  misc_feature (36): n=a or g
aatttaggcctttcatcactttgtggagctcccacngtgttcattgagtgcagctgctgtccctctggttg

SEQ ID NO: 46611 - DNA, 71 bp, chicken (Gallus Gallus)
  misc_feature (36): n=a or g
acctacagtagctgctcagtatcagaactctatcanaaacctgcaaaagcctaaaattcacgactcctcaa

SEQ ID NO: 46612 - DNA, 71 bp, chicken (Gallus Gallus)
  misc_feature (36): n=a or g
cttggtggttctactgtataaagcaaacttgatgcnagtgagcttggtcccaaagccaatgaatagatacc

SEQ ID NO: 46613 - DNA, 71 bp, chicken (Gallus Gallus)
  misc_feature (36): n=c or t
atttgcctttgcttttacaaatgcactaactttacnaagagtggaaattagaatgtccttctctgaaatat

SEQ ID NO: 46614 - DNA, 71 bp, chicken (Gallus Gallus)
  misc_feature (36): n=a or g
tcatgttatatagcttttaatttagccaagcctgantgattaagttactatatagaacgtgggcccagcag

SEQ ID NO: 46615 - DNA, 71 bp, chicken (Gallus Gallus)
  misc_feature (36): n=c or t
tggaattattcatcatactccagttctaataaatanaacccttaaatatcttgaaccagattactgatacc

SEQ ID NO: 46616 - DNA, 71 bp, chicken (Gallus Gallus)
  misc_feature (36): n=a or c
tcctgtctcatatttctacccgcaagacagatgtcnatgttgtctaatggatagatctggtctaagctatt

SEQ ID NO: 46617 - DNA, 71 bp, chicken (Gallus Gallus)
  misc_feature (36): n=a or g
ttaagtgcctgtacatactccagtaactctcgaagnatatatatgtgctgaaaaaattaagtaattcacat

SEQ ID NO: 46618 - DNA, 71 bp, chicken (Gallus Gallus)
  misc_feature (36): n=a or g
caggagacagaaggccagaaaggctccaactatgtngtccacatgtagctggagaagaggtgggagtagat

SEQ ID NO: 46619 - DNA, 71 bp, chicken (Gallus Gallus)
  misc_feature (36): n=c or t
tattgtttcctatgggaacagaatggttgtaatganagataatgtggctgtcagaggggaggtgtcatcac

SEQ ID NO: 46620 - DNA, 71 bp, chicken (Gallus Gallus)
  misc_feature (36): n=c or t
gaccagaatatgccttagaatcccatgttcccaggnggactgcatgggaaacacaggctgactgggacaga

SEQ ID NO: 46621 - DNA, 71 bp, chicken (Gallus Gallus)
  misc_feature (36): n=a or g
tgctctacccatgcttaaagctaacactgtttacantgaagtcagtggaaattcagctcctggcaaaatct

SEQ ID NO: 46622 - DNA, 71 bp, chicken (Gallus Gallus)
  misc_feature (36): n=a or g
tgtaagattgaaagaggagttgaagtgttttcaagntttgcacctcatacaaccaaatcttttaaaaagta

SEQ ID NO: 46623 - DNA, 71 bp, chicken (Gallus Gallus)
  misc_feature (36): n=c or t
ctgctgttgtagtcacaaaggttacattgagcactntccaggaggagggattttacagctggtcttttctt

SEQ ID NO: 46624 - DNA, 71 bp, chicken (Gallus Gallus)
  misc_feature (36): n=c or t
aacacaacactgcccattctttttctgagtgattgnatccaacggctgacatttcatatcaaccaccacat

SEQ ID NO: 46625 - DNA, 71 bp, chicken (Gallus Gallus)
  misc_feature (36): n=c or t
ctctttatatacaagctatataaagcatagttcatntaatatgccatttcagaatctgagatgattttagg

SEQ ID NO: 46626 - DNA, 71 bp, chicken (Gallus Gallus)
  misc_feature (36): n=c or t
ctgcagttcatgtgtacacacaatacagaacagatnaatatgacaagcaaaggtctcactgactgtgactt

SEQ ID NO: 46627 - DNA, 71 bp, chicken (Gallus Gallus)
  misc_feature (36): n=a or c
tttatcttaaagatagtctgcagtcattttggtctncaatactaattatcttttgtgttagattttcttcc

SEQ ID NO: 46628 - DNA, 71 bp, chicken (Gallus Gallus)
  misc_feature (36): n=c or t
agatcactcatcaacagaagagtaataatacgctanttccctacacttaagacaccatggaaattgcagta

SEQ ID NO: 46629 - DNA, 71 bp, chicken (Gallus Gallus)
  misc_feature (36): n=a or g
caaaatctttaaaaaaagctgcaaggccacatactntattttattctttggacacgctgggagaaacctga

SEQ ID NO: 46630 - DNA, 71 bp, chicken (Gallus Gallus)
  misc_feature (36): n=a or g
gttaattcccacctcatgtagcagtgaaatattttntagctgtggcactgaaagggtaactgaattccttg

SEQ ID NO: 46631 - DNA, 71 bp, chicken (Gallus Gallus)
  misc_feature (36): n=c or t
atccctcactgaaataatcgtgttttacttctgtgnggagtgtggagaccaggcctaaattcattccagtt

SEQ ID NO: 46632 - DNA, 71 bp, chicken (Gallus Gallus)
  misc_feature (36): n=g or t
tgtctgtatgtgctacatcttagctggcatcctgcncttcatgtgctattccatctgtgtgaaattgtgtt

SEQ ID NO: 46633 - DNA, 71 bp, chicken (Gallus Gallus)
  misc_feature (36): n=a or c
gtgatttggctcatgagaactatagcatatgatacnggtagattaaattgttattttggggcacttggaat

SEQ ID NO: 46634 - DNA, 71 bp, chicken (Gallus Gallus)
  misc_feature (36): n=a or g
cacacgaacctgtaggttcacgtgtgtacatgtatntccacaccccgctggcataggaggtggagatgtgc

SEQ ID NO: 46635 - DNA, 71 bp, chicken (Gallus Gallus)
  misc_feature (36): n=c or t
gcacagcctcactcattcctagcaccatttccttcngtgtggtgtcacaacatagtctgtttctgtgtttc

SEQ ID NO: 46636 - DNA, 71 bp, chicken (Gallus Gallus)
  misc_feature (36): n=a or g
tgtcgctattagtagttatagaatgataatacctcnggatgaattatgtattaactgtttcagtgaaaaaa

SEQ ID NO: 46637 - DNA, 71 bp, chicken (Gallus Gallus)
  misc_feature (36): n=a or c
cacctttaatactgaaaatactttatgcaggctggnagatttagaaatatgatgttatcctaactagtgtc

SEQ ID NO: 46638 - DNA, 71 bp, chicken (Gallus Gallus)
  misc_feature (36): n=c or t
ggaggggatggaagataacctaccaagctcccattnagctaatgaactggaaaaccctacatagtctatga

SEQ ID NO: 46639 - DNA, 71 bp, chicken (Gallus Gallus)
  misc_feature (36): n=c or t
gagcatcagatacagagccggaatgaacagaaaacngttggaatgtgtttgctgcatttctcatggaaggt

SEQ ID NO: 46640 - DNA, 71 bp, chicken (Gallus Gallus)
  misc_feature (36): n=a or g
ggcagctatgaaaaccatacaaacaaaaatgcaacntttagacaagcagtcttcttaacacagtgtcttat

SEQ ID NO: 46641 - DNA, 71 bp, chicken (Gallus Gallus)
  misc_feature (36): n=a or g
ataatagaaaactaagctcaaccacgtaataaaacngaagaaattttacctactatttgcttgactttgga

SEQ ID NO: 46642 - DNA, 71 bp, chicken (Gallus Gallus)
  misc_feature (36): n=a or g
aggatggtcctggtgtcagggaacattccccagtangcactggctgtagaaggcaccatgccacaggcaca

SEQ ID NO: 46643 - DNA, 71 bp, chicken (Gallus Gallus)
  misc_feature (36): n=a or g
gtttcattttaccatgttggaatgcaataaaacatnatgttattaactcgcctgaacaatctattagtcga

SEQ ID NO: 46644 - DNA, 71 bp, chicken (Gallus Gallus)
  misc_feature (36): n=c or t
ttaagggcttggatcatttagaaaccctctgcatangccacccctgaggacctgttcttcataccaaggca

SEQ ID NO: 46645 - DNA, 71 bp, chicken (Gallus Gallus)
  misc_feature (36): n=c or t
tacatgtaagcagagtacagactacatggtcattantgagacatataacctggagcacaagactggagggt

SEQ ID NO: 46646 - DNA, 71 bp, chicken (Gallus Gallus)
  misc_feature (36): n=a or g
ttaatatggatatgattggaacaatcaaggctatantgaaggatgctcagctttcttagtccatgagatta

SEQ ID NO: 46647 - DNA, 71 bp, chicken (Gallus Gallus)
  misc_feature (36): n=a or g
atgctgttgcctgatattttatgcttcaaaaagtgngattatcccatataaactgtgcactgatattctgc

SEQ ID NO: 46648 - DNA, 71 bp, chicken (Gallus Gallus)
  misc_feature (36): n=a or c
caaattccaaagtaatctttatttgaccatactgantgcttagatctctgcccctcatactttttctattt

SEQ ID NO: 46649 - DNA, 71 bp, chicken (Gallus Gallus)
  misc_feature (36): n=a or c
caacacttttaaaccagttaaaatagatgttaaaanaactgtgatggaacactgtgtattaaaagagacaa

SEQ ID NO: 46650 - DNA, 71 bp, chicken (Gallus Gallus)
  misc_feature (36): n=a or g
atgcatatcaaccatttaggtactgagtgccattangtatgaaggatgctgtaatgacatcaggagagaag

SEQ ID NO: 46651 - DNA, 71 bp, chicken (Gallus Gallus)
  misc_feature (36): n=c or t
ctgtacttttctccagtgtgattaattattgtatantggggctgctcttatacttcagggaatggcagctc

SEQ ID NO: 46652 - DNA, 71 bp, chicken (Gallus Gallus)
  misc_feature (36): n=a or g
actgaataaatcttcaaagtgtattattatgactcnggttagaatttagtacttgagtatgctttctctcg

SEQ ID NO: 46653 - DNA, 71 bp, chicken (Gallus Gallus)
  misc_feature (36): n=a or g
agtgtttctggacattcgtatttccttatacagtanctttggctgtgtgtagactaatagatacatccttc

SEQ ID NO: 46654 - DNA, 71 bp, chicken (Gallus Gallus)
  misc_feature (36): n=c or t
cttacctcccagcgtaaacagtatgcttaacattgnggcagtggagtaaagatggtaatttcatcctccta

SEQ ID NO: 46655 - DNA, 71 bp, chicken (Gallus Gallus)
  misc_feature (36): n=c or t
caagtaacagacttcactgtaacaaaaatgcatcantgagctgactgaaatgctctgtttaagcattttaa

SEQ ID NO: 46656 - DNA, 71 bp, chicken (Gallus Gallus)
  misc_feature (36): n=c or t
ttagatatacacgcaggttaagttttaggtgagacnccagtttccacagtaccattccagggtaatgcaac

SEQ ID NO: 46657 - DNA, 71 bp, chicken (Gallus Gallus)
  misc_feature (36): n=c or t
actttggcctcccagctcacagatggtgattgtacngcatagacatactttcttccacttgggatgtcagt

SEQ ID NO: 46658 - DNA, 71 bp, chicken (Gallus Gallus)
  misc_feature (36): n=a or g
tgtctgcctttgcctttaaattctccttatggttanttattaactacgatgtattagtttgctgtacaagt

SEQ ID NO: 46659 - DNA, 71 bp, chicken (Gallus Gallus)
  misc_feature (36): n=g or t
gctctcttagtagccagctgttgctggttcatatgncagtcatcttccagaatgatcttgtttgcttctag

SEQ ID NO: 46660 - DNA, 71 bp, chicken (Gallus Gallus)
  misc_feature (36): n=c or t
aaaattcacattcaaagtgtttgtaaggaatagtgnttgtaaggatagtgagcgaacacatgtactcttac

SEQ ID NO: 46661 - DNA, 71 bp, chicken (Gallus Gallus)
  misc_feature (36): n=a or g
aatactttgacatgcactaccatttctggagtatcncataattgttgcactactgaacagatgtaaaaaat

SEQ ID NO: 46662 - DNA, 71 bp, chicken (Gallus Gallus)
  misc_feature (36): n=c or t
tacatcacctgtatttgaagtgtgctgaatgtctangctttgtgacatagtatttctgccaaaagatgaaa

SEQ ID NO: 46663 - DNA, 71 bp, chicken (Gallus Gallus)
  misc_feature (36): n=g or t
cagtgcagctgtgcccccaagccctgtggccagcantttttttctgtactgttcatcagaccacacttgta

SEQ ID NO: 46664 - DNA, 71 bp, chicken (Gallus Gallus)
  misc_feature (36): n=a or g
aaatgctgaaaggatgacaacagatgaaggaggagngatgcataggcttctcctgcagtccaggaaacctc

SEQ ID NO: 46665 - DNA, 71 bp, chicken (Gallus Gallus)
  misc_feature (36): n=a or g
tgcagatgggagacaaatttacaggacatggtttgnggaagttttagcactaactgaaagtctttgaggac

SEQ ID NO: 46666 - DNA, 71 bp, chicken (Gallus Gallus)
  misc_feature (36): n=a or g
aaatacaaatggtatgaatcatgagacaaatggaanatgggtgttatcttctgcatgtgatgataagatat

SEQ ID NO: 46667 - DNA, 71 bp, chicken (Gallus Gallus)
  misc_feature (36): n=c or t
acttctccacagtaaccagagcgatgttcaaaccangctcatagaccgggacatagctggattgactgaga

SEQ ID NO: 46668 - DNA, 71 bp, chicken (Gallus Gallus)
  misc_feature (36): n=c or t
ctggtcttgaaagtcctgtttatgtgaaagtgaaanggcactaacaacaaacttaggaaaataattttaag

SEQ ID NO: 46669 - DNA, 71 bp, chicken (Gallus Gallus)
  misc_feature (36): n=a or g
gtcaaggcatttttttaacaacatttagctcatacntattgcacttgctggtttttagtaacaagttttta

SEQ ID NO: 46670 - DNA, 71 bp, chicken (Gallus Gallus)
  misc_feature (36): n=a or g
gtaggaagtatttgtcctcatgagccaaaaagaacnagtatagatacctgggtctgaaatgagttaaacca

SEQ ID NO: 46671 - DNA, 71 bp, chicken (Gallus Gallus)
  misc_feature (36): n=c or t
tcctgttggtgcaaaagattagcagggaaacagaanatggctgacagaagtatgctggaagcagaagccct

SEQ ID NO: 46672 - DNA, 71 bp, chicken (Gallus Gallus)
  misc_feature (36): n=a or g
tcatgcctggctcattaagttacaagatatttaccntgggtaatgtttattccaaatcatttaatgcagct

SEQ ID NO: 46673 - DNA, 71 bp, chicken (Gallus Gallus)
  misc_feature (36): n=a or g
aaacactgcaatttcatgcaactaccatcctttatngtagcatactgcaattttataagacttcttcacat

SEQ ID NO: 46674 - DNA, 71 bp, chicken (Gallus Gallus)
  misc_feature (36): n=c or t
ccccacagattgaaggtagccaggattaaaattccnaagtctgacaattagaagaagaaactgacaatatt

SEQ ID NO: 46675 - DNA, 71 bp, chicken (Gallus Gallus)
  misc_feature (36): n=a or g
ttgacatcagcttcatttgccacaattcttaacaanttacagcacttagttccaaaatcacaaaaccagaa

SEQ ID NO: 46676 - DNA, 71 bp, chicken (Gallus Gallus)
  misc_feature (36): n=c or t
catcacactagggaaggcaggaggggttaataggangttggctctcctgagagacttggctcctgtgccaa

SEQ ID NO: 46677 - DNA, 71 bp, chicken (Gallus Gallus)
  misc_feature (36): n=a or g
tgctgtggtccaaccccttgacagggagaagacccnttatttgccagccaacagactgggtaaaggatagg

SEQ ID NO: 46678 - DNA, 71 bp, chicken (Gallus Gallus)
  misc_feature (36): n=a or g
aacgaacataggtgatgttaagttctggttccagcntagaaacatagcaaagagttgtgcaaacttcaaca

SEQ ID NO: 46679 - DNA, 71 bp, chicken (Gallus Gallus)
  misc_feature (36): n=c or t
aaatagaattcttcaaatattagttcttagggcttntaaataatgtctgtaagtcccaaaagctggtactt

SEQ ID NO: 46680 - DNA, 71 bp, chicken (Gallus Gallus)
  misc_feature (36): n=c or t
attaatgagctgaaattggccctctccttggatccntggaaatgaatttattgaagtatgaagccaaagaa

SEQ ID NO: 46681 - DNA, 71 bp, chicken (Gallus Gallus)
  misc_feature (36): n=a or c
tgattttggacagaaaaatctgcactctgcctttgnggggaggtggacagttgctgtaaagtgcaaaatga

SEQ ID NO: 46682 - DNA, 71 bp, chicken (Gallus Gallus)
  misc_feature (36): n=a or g
gatgctaaaggtatgtggagcaggttagcaactgcntgttagctgatgtcaagagtttcaaccagctaaca

SEQ ID NO: 46683 - DNA, 71 bp, chicken (Gallus Gallus)
  misc_feature (36): n=a or g
gtgctgaagttcttgcaaattccatgctttggaaanttttgtgctcccttaccaccacatacaagtaaatt

SEQ ID NO: 46684 - DNA, 71 bp, chicken (Gallus Gallus)
  misc_feature (36): n=a or g
ggctcagagagtctaaaacacagcatagtggaaagnactgcaggacttcatgttaacaggcagcaatctcc

SEQ ID NO: 46685 - DNA, 71 bp, chicken (Gallus Gallus)
  misc_feature (36): n=a or g
ttttttacttttattttaaattggcagacttctgcnttgttcttatagagcttcaactgcagaaattttcc

SEQ ID NO: 46686 - DNA, 71 bp, chicken (Gallus Gallus)
  misc_feature (36): n=a or g
gaagaaattaaccccgaatacatgttagagaaatcnttctatcagtttcaacattacagagctattccggg

SEQ ID NO: 46687 - DNA, 71 bp, chicken (Gallus Gallus)
  misc_feature (36): n=c or t
acaggaacacaggatggtccagccatcacccttccntacaacacacactgtgaaagaagatatgcctgttc

SEQ ID NO: 46688 - DNA, 71 bp, chicken (Gallus Gallus)
  misc_feature (36): n=c or t
aatccaataattctgtgggagatatgaccccacagncccaacactgttcagggagaaatgccatcacagca

SEQ ID NO: 46689 - DNA, 71 bp, chicken (Gallus Gallus)
  misc_feature (36): n=a or g
catatctcatgtcacaccaagacataccacgaagangagagaaaggcttcatttacacttacaagtcacgt

SEQ ID NO: 46690 - DNA, 71 bp, chicken (Gallus Gallus)
  misc_feature (36): n=c or t
taagatgagacaaaacgttaaggaaacttcagctgnagtttggcaaatggccaggttagagcagaatagtc

SEQ ID NO: 46691 - DNA, 71 bp, chicken (Gallus Gallus)
  misc_feature (36): n=a or g
ttattttctcccttttattttttttcctggttcccnaaggacttcccattttttatgaactcaccctcaat

SEQ ID NO: 46692 - DNA, 71 bp, chicken (Gallus Gallus)
  misc_feature (36): n=c or t
aatgcccaggtgtgcaggtaagcatgccagctggcnacccagagttgagacagatatcctctccctgctga

SEQ ID NO: 46693 - DNA, 71 bp, chicken (Gallus Gallus)
  misc_feature (36): n=g or t
acagctccacccattggtgacactgtagggcactgngatttagccatgtgcaggttaagatgctagcaaag

SEQ ID NO: 46694 - DNA, 71 bp, chicken (Gallus Gallus)
  misc_feature (36): n=c or t
agtttttcaccctctttgggagcaatgcagaataanttccttctcacagataagatgacaaatgcttctct

SEQ ID NO: 46695 - DNA, 71 bp, chicken (Gallus Gallus)
  misc_feature (36): n=c or t
gactgtgacatcttggaaatgtttgtggaggtgccnggggcagttggctgcttaactgagatctgcacaaa

SEQ ID NO: 46696 - DNA, 71 bp, chicken (Gallus Gallus)
  misc_feature (36): n=a or c
ctctttgtaagcagtggaacgtgagtccatctaganagttgctcatgggacatctgaacaggaacagggag

SEQ ID NO: 46697 - DNA, 71 bp, chicken (Gallus Gallus)
  misc_feature (36): n=a or g
ctagtgagagttcttaaactctgagaaatagaaatngaaatgaaggttgtagatgccacttctgcctgaga

SEQ ID NO: 46698 - DNA, 71 bp, chicken (Gallus Gallus)
  misc_feature (36): n=c or t
aaactaatgagagcccagtttatgcaagtgctgcangttcagatcagagaaaccatctaggcagaagagct

SEQ ID NO: 46699 - DNA, 71 bp, chicken (Gallus Gallus)
  misc_feature (36): n=a or g
cccatctttttcaagaatctgtgatgagactcctcnctccccatggaggtatgagcatagggatgagcctc

SEQ ID NO: 46700 - DNA, 71 bp, chicken (Gallus Gallus)
  misc_feature (36): n=a or g
gtaggatcaatttattttgtagctttgttatttcanagttgctctattttaaccaagtagtttgccctctg

SEQ ID NO: 46701 - DNA, 71 bp, chicken (Gallus Gallus)
  misc_feature (36): n=c or t
gttattgcagggatgtgtatggtcctctgctccaancagtagatggaatgaaattcaaactattgcatgtt

SEQ ID NO: 46702 - DNA, 71 bp, chicken (Gallus Gallus)
  misc_feature (36): n=c or t
ttgaaaatcaaatgccatagccaagtaataaaaagntatggtccaggtactctgagccatttcttcctcct

SEQ ID NO: 46703 - DNA, 71 bp, chicken (Gallus Gallus)
  misc_feature (36): n=a or g
ggcttttaacactgcttcttctgcttactttcaaancaggagttttacactgtgtgacattctgaaaaacc

SEQ ID NO: 46704 - DNA, 71 bp, chicken (Gallus Gallus)
  misc_feature (36): n=c or t
gtttgggcagaaaccatgaggactagtcaatgacangagaaggccaaaaccaacttctgaattctctgcag

SEQ ID NO: 46705 - DNA, 71 bp, chicken (Gallus Gallus)
  misc_feature (36): n=a or c
ggctaacagagtctgtcattatgtgtatctacttanggttactcttttcaaccatgtttactatttggcac

SEQ ID NO: 46706 - DNA, 71 bp, chicken (Gallus Gallus)
  misc_feature (36): n=g or t
gggatcccagagataggataaaagctcaaggtcttnctttcatgtcaggctactaccaattttattgatct

SEQ ID NO: 46707 - DNA, 71 bp, chicken (Gallus Gallus)
  misc_feature (36): n=a or c
agtcaagcatgttggtgcaaatgataccgcacatgntatttccatatatcccttccatatagctgcagcag

SEQ ID NO: 46708 - DNA, 71 bp, chicken (Gallus Gallus)
  misc_feature (36): n=a or g
cagtttgcctgaattaaattttgccttcatctgttnccatctctctactcctatgttttctgtttccttca

SEQ ID NO: 46709 - DNA, 71 bp, chicken (Gallus Gallus)
  misc_feature (36): n=a or g
ctggggacaacaggcattggtgaagtaccatgtacntttactatgacaacgaagccttactaacactcttt

SEQ ID NO: 46710 - DNA, 71 bp, chicken (Gallus Gallus)
  misc_feature (36): n=a or g
acaaccaacaaactactatggtattccaacaaagtnctatggaggtttaacttttaataattgttttacaa

SEQ ID NO: 46711 - DNA, 71 bp, chicken (Gallus Gallus)
  misc_feature (36): n=c or t
gtgaccagtgcctgtatggcaacaaggatgtacaanaagcatgtctgcttacagtggaaaatgctacatga

SEQ ID NO: 46712 - DNA, 71 bp, chicken (Gallus Gallus)
  misc_feature (36): n=g or t
caatcagaaggtgagatcttgtacaggactgcagangaagaactggagaggggataatacctagactgatt

SEQ ID NO: 46713 - DNA, 71 bp, chicken (Gallus Gallus)
  misc_feature (36): n=c or t
ttgaccactctaacttcaccagatgttcagagagtncaaagctataagcccaaatccaggccatgtgagtg

SEQ ID NO: 46714 - DNA, 71 bp, chicken (Gallus Gallus)
  misc_feature (36): n=g or t
ggaattttcttctttaatgctaaataacatctcagnaaatgtatagcttagagttgcctttaccaacagtc

SEQ ID NO: 46715 - DNA, 71 bp, chicken (Gallus Gallus)
  misc_feature (36): n=a or g
tgataattcatcatacactggagaagagctgaaacnacaagagtgttgggatgaacagggcttccataaca

SEQ ID NO: 46716 - DNA, 71 bp, chicken (Gallus Gallus)
  misc_feature (36): n=a or g
tgtagtaggcaactgaagcaagaaaaatcatcctanactaacagtgagggggggaggagggggggggggaa

SEQ ID NO: 46717 - DNA, 71 bp, chicken (Gallus Gallus)
  misc_feature (36): n=a or c
caggctttctatttaaaataagaatatggtatctanatttaaagatttgagaggagggaatcatttttgtg

SEQ ID NO: 46718 - DNA, 71 bp, chicken (Gallus Gallus)
  misc_feature (36): n=a or g
cacataactctcaaccagtttgagcttaaaaagaanagagatcaggggccaaattacaaagcaatttagct

SEQ ID NO: 46719 - DNA, 71 bp, chicken (Gallus Gallus)
  misc_feature (36): n=c or t
tggccctgcaagagcaaggtgtgtgcttgacagtgnttttgtgcgtgtcagtgatgccaccctaaaatgat

SEQ ID NO: 46720 - DNA, 71 bp, chicken (Gallus Gallus)
  misc_feature (36): n=a or g
tgttgtttttttttgccctaaatgcttatgtgctantggcatagaggatgggcgctggttgtcactgctca

SEQ ID NO: 46721 - DNA, 71 bp, chicken (Gallus Gallus)
  misc_feature (36): n=a or g
atcacagttccttggtcagcgacctcactaatcatngatgcatgtattaaggcaccagcctgggcctccat

SEQ ID NO: 46722 - DNA, 71 bp, chicken (Gallus Gallus)
  misc_feature (36): n=a or g
aagagtttatagaatcaagggagaaagaagctaatnggttgtaccacattcatccaagggttgactgttaa

SEQ ID NO: 46723 - DNA, 71 bp, chicken (Gallus Gallus)
  misc_feature (36): n=c or t
aaataatttctaattttgaagcgaatgcccaagtantaccatggtcagtatttgaaatgaccaggtcgtct

SEQ ID NO: 46724 - DNA, 71 bp, chicken (Gallus Gallus)
  misc_feature (36): n=c or t
ctctcagggaaaagtctatcaattagttatgaatgngctgaatttatgattcatttatgatgaaatgtgct

SEQ ID NO: 46725 - DNA, 71 bp, chicken (Gallus Gallus)
  misc_feature (36): n=a or g
tcctaaaggggaaattattcacatgcatcatgttcncaaatcttccaacattagtgttttccttgtcagac

SEQ ID NO: 46726 - DNA, 71 bp, chicken (Gallus Gallus)
  misc_feature (36): n=c or t
agaatggctaaacttaatgctcttttgtcgctatgntacacacagcaacattccatcattaaaaaagggta

SEQ ID NO: 46727 - DNA, 71 bp, chicken (Gallus Gallus)
  misc_feature (36): n=a or g
agtcgcatgtgaatacctgatgtaaaatttatctgnaaagtgatatgtgctatatgaaacaaaaccttttt

SEQ ID NO: 46728 - DNA, 71 bp, chicken (Gallus Gallus)
  misc_feature (36): n=c or t
ttacggaaagtgtggtgagcagggaaaatattcatntgtcctatgaagagacaaaagggagaaactgaaaa

SEQ ID NO: 46729 - DNA, 71 bp, chicken (Gallus Gallus)
  misc_feature (36): n=c or t
ctgcaaatatataatgtgaaagcatttatcttctantactgttgctgtatagccatggctatagctatggc

SEQ ID NO: 46730 - DNA, 71 bp, chicken (Gallus Gallus)
  misc_feature (36): n=a or g
acttgcactgcagcaatacagtgctcaggagcaatntaggtcctgacaagtctgaggccaagcaacagtgc

SEQ ID NO: 46731 - DNA, 71 bp, chicken (Gallus Gallus)
  misc_feature (36): n=g or t
ttcctcctcatgcctggctttctctgctgataatgntttctttcccattgcagtctttcctttttgctaac

SEQ ID NO: 46732 - DNA, 71 bp, chicken (Gallus Gallus)
  misc_feature (36): n=a or g
aaaaaaaaaagagaaaacaacgctgctcccttcccngcactctcttgttgtcagcttggttagttcttgtc

SEQ ID NO: 46733 - DNA, 71 bp, chicken (Gallus Gallus)
  misc_feature (36): n=g or t
ttgctggcttgatatttgtaccttactgaaaacatntctatattttaaaattgctatcttatgttaagcac

SEQ ID NO: 46734 - DNA, 71 bp, chicken (Gallus Gallus)
  misc_feature (36): n=g or t
gagaaacttaactttatttcatttgcaaaccaaaangtagaatctgtagagaggtaatgggctggaggacc

SEQ ID NO: 46735 - DNA, 71 bp, chicken (Gallus Gallus)
  misc_feature (36): n=a or g
aaatgccagcccaggtgaggcggcagaacctacganttaccattcctccagacacccatcactgcatctct

SEQ ID NO: 46736 - DNA, 71 bp, chicken (Gallus Gallus)
  misc_feature (36): n=c or t
tcagaaatttaactctgaggttagaggatgtgcacnggggtagacgtgcttgctgtcagtacaccacgatg

SEQ ID NO: 46737 - DNA, 71 bp, chicken (Gallus Gallus)
  misc_feature (36): n=c or t
gttttggtatgtagcagttcttgaatttgagccagntgtcacaccagcaaaccaaagctttctctgtctct

SEQ ID NO: 46738 - DNA, 71 bp, chicken (Gallus Gallus)
  misc_feature (36): n=a or g
gagctcagactgtttgttttcagcttatggtgtctncagtcttatggcagtaatgtgatgctggcagcaga

SEQ ID NO: 46739 - DNA, 71 bp, chicken (Gallus Gallus)
  misc_feature (36): n=c or t
cattgtcatgtgctttgtgtggggagggaggaaganggtaaccacagggacagtgctggcaccctgagcaa

SEQ ID NO: 46740 - DNA, 71 bp, chicken (Gallus Gallus)
  misc_feature (36): n=a or g
tcttggtggtcactattgtctacatttatcttctcncagcatcagaacatagagtggagctttagagaaaa

SEQ ID NO: 46741 - DNA, 71 bp, chicken (Gallus Gallus)
  misc_feature (36): n=a or g
catgatgtatgtggagcaacccttcccctgagaggngagcgagaagctggtatacacttgccctggactta

SEQ ID NO: 46742 - DNA, 71 bp, chicken (Gallus Gallus)
  misc_feature (36): n=g or t
agactgtgactcagagagcaggtgatggctatttcnttctgtgtatggaactataatccttctcaattatc

SEQ ID NO: 46743 - DNA, 71 bp, chicken (Gallus Gallus)
  misc_feature (36): n=c or t
ctcattttttagcagatagatagaattttaaaagcntgttgaattttgtgcttgattcctttagaagggaa

SEQ ID NO: 46744 - DNA, 71 bp, chicken (Gallus Gallus)
  misc_feature (36): n=c or t
ctttactctaacacttcacataaattcctctgttanatgtaatacatgcacatacattacagtagggaagg

SEQ ID NO: 46745 - DNA, 71 bp, chicken (Gallus Gallus)
  misc_feature (36): n=a or c
gctagatgatgacatcaataatgaagaattcacgtnttttaaaggcacagcttcattttgcagcaccctag

SEQ ID NO: 46746 - DNA, 71 bp, chicken (Gallus Gallus)
  misc_feature (36): n=a or c
cagacctgaaacttccctggcactgtatcttctaancacaagaaagtgataatcttttcctctatcagaaa

SEQ ID NO: 46747 - DNA, 71 bp, chicken (Gallus Gallus)
  misc_feature (36): n=c or t
gggcattccagagggctagattttcactcagaaagngaatcaaagcctcaaacaaaacaggaactgtcttt

SEQ ID NO: 46748 - DNA, 71 bp, chicken (Gallus Gallus)
  misc_feature (36): n=a or g
tcctacaactatgacctctgcaaagggatgctttgnattctgtagtaagtatgtagctatgaaatggtact

SEQ ID NO: 46749 - DNA, 71 bp, chicken (Gallus Gallus)
  misc_feature (36): n=a or g
tgttcataaaggacaaatggtctgtaggcttccttntgaagctttttcagagcacagtggctaaacaaata

SEQ ID NO: 46750 - DNA, 71 bp, chicken (Gallus Gallus)
  misc_feature (36): n=c or t
gcttcaagtctacccttatcaaccttacttcctaangtaggaaagcatctgaaatgttactatgcactgct

SEQ ID NO: 46751 - DNA, 71 bp, chicken (Gallus Gallus)
  misc_feature (36): n=c or t
atgagataatcccaagtcaaactccaccccctttangtgagtttttgtcataggctagatattttgtttaa

SEQ ID NO: 46752 - DNA, 71 bp, chicken (Gallus Gallus)
  misc_feature (36): n=c or t
tagtttataatctgttttgcaaatcagaggttgttntaattcttccagataccatctgcatatcttgatag

SEQ ID NO: 46753 - DNA, 71 bp, chicken (Gallus Gallus)
  misc_feature (36): n=a or g
agggaatctgagctcaggaatttcctttctcagtgngctctgagacttagcattacattttgctttctgat

SEQ ID NO: 46754 - DNA, 71 bp, chicken (Gallus Gallus)
  misc_feature (36): n=a or g
tattatgtgcaaaatttaacaagtcttaattcagtncttccccttcaaccagatcgttaccattctcctac

SEQ ID NO: 46755 - DNA, 71 bp, chicken (Gallus Gallus)
  misc_feature (36): n=c or t
tttttagaaaatccctggtctctctggatctggacnagtgacattaagaatgcagggacagatgccaccat

SEQ ID NO: 46756 - DNA, 71 bp, chicken (Gallus Gallus)
  misc_feature (36): n=c or t
gcttgtgaaaatgacagtaacccctgacaatttagnatctatacattgtttctttgtatatccttattcca

SEQ ID NO: 46757 - DNA, 71 bp, chicken (Gallus Gallus)
  misc_feature (36): n=c or t
atgcagtgggtgagcaccttctccctcagatatctngactccatgacgacacccgtatactgcgatgatgc

SEQ ID NO: 46758 - DNA, 71 bp, chicken (Gallus Gallus)
  misc_feature (36): n=a or g
agtgataaaagaaagcttctatcctctgcatttgtnaagacaaaactgaatgtaggaagtctgttctcaga

SEQ ID NO: 46759 - DNA, 71 bp, chicken (Gallus Gallus)
  misc_feature (36): n=a or g
attattgcagactatattctcccatccattccaatncaaatattagaattgcaaatgttttaaaagctttg

SEQ ID NO: 46760 - DNA, 71 bp, chicken (Gallus Gallus)
  misc_feature (36): n=g or t
aatgatggaagagtacatgtgtccctgtacaacacngactacagaacttcccattgccttttgcactgaaa

SEQ ID NO: 46761 - DNA, 71 bp, chicken (Gallus Gallus)
  misc_feature (36): n=a or c
taactccaaaggagggaaatgtgcccctttctcagntgctctataatacatggagtatatatgtatggagt

SEQ ID NO: 46762 - DNA, 71 bp, chicken (Gallus Gallus)
  misc_feature (36): n=c or t
tgttttcacatagcaatttcatacccatctgtgttngcctagtgcaatataaatctaccatagaggaaatc

SEQ ID NO: 46763 - DNA, 71 bp, chicken (Gallus Gallus)
  misc_feature (36): n=c or t
tcattccagcagatgagcatacaggtcacagctcangggttgactttggctgatttagaaactacaaatcc

SEQ ID NO: 46764 - DNA, 71 bp, chicken (Gallus Gallus)
  misc_feature (36): n=g or t
aacccagaaacaggatactcacaagcaggcccgagnttcatgcaagagtcagaactgcagacagagaaacc

SEQ ID NO: 46765 - DNA, 71 bp, chicken (Gallus Gallus)
  misc_feature (36): n=a or c
tggatctacaatccactctacaatcttgctgacaanttttcattacaactactgtccctactcataagatt

SEQ ID NO: 46766 - DNA, 71 bp, chicken (Gallus Gallus)
  misc_feature (36): n=a or g
caataagctttcaatagatcttgattttgttttctnattatttggctccttgattctttcagccagaatct

SEQ ID NO: 46767 - DNA, 71 bp, chicken (Gallus Gallus)
  misc_feature (36): n=c or t
gagagtttgtgctttgtttactaattaatttgacantatgatcagttacttggggaaataaatcttttcac

SEQ ID NO: 46768 - DNA, 71 bp, chicken (Gallus Gallus)
  misc_feature (36): n=g or t
cagctgcactgcaggttcccaggatgcagccttccntcagtctttttctgacttgattcctacagtacttc

SEQ ID NO: 46769 - DNA, 71 bp, chicken (Gallus Gallus)
  misc_feature (36): n=a or g
ataatcagtagaatatttattttacgcatgtaaatntagactgtggaatgtacagtacataggtaacttgt

SEQ ID NO: 46770 - DNA, 71 bp, chicken (Gallus Gallus)
  misc_feature (36): n=g or t
acatgtaacttcccctgagttcatgtgaagttgagncggtagacctaaaaataacatcctgatggtattcc

SEQ ID NO: 46771 - DNA, 71 bp, chicken (Gallus Gallus)
  misc_feature (36): n=a or g
atctatagacaggattgttcttgacagtatgtcacnaaacgtcaggggagggtttcaatgcagcaattcca

SEQ ID NO: 46772 - DNA, 71 bp, chicken (Gallus Gallus)
  misc_feature (36): n=a or g
atattgatggagtagactcttctaaagatcagtcancaggtcaaaactaggattcacaattaatttggata

SEQ ID NO: 46773 - DNA, 71 bp, chicken (Gallus Gallus)
  misc_feature (36): n=g or t
ttcctgtgctcacacaaaattgcagggaaaacagtnctgtagcacttttcccccactccccagtgggtgat

SEQ ID NO: 46774 - DNA, 71 bp, chicken (Gallus Gallus)
  misc_feature (36): n=c or t
agtgtgaacatacctgatgagacagtattggttctngttaattgttaagaaacttgcaatgagtgtgaata

SEQ ID NO: 46775 - DNA, 71 bp, chicken (Gallus Gallus)
  misc_feature (36): n=a or g
aaagtaatagtgtcgtagaaaatagtctatctgtgncaaatgcttttcaggttgtacaatctctgctgctg

SEQ ID NO: 46776 - DNA, 71 bp, chicken (Gallus Gallus)
  misc_feature (36): n=a or g
tggaggaccagtagctgggccgctaagaaccaatancgttgaaagatagaacagaagatacaaattcacaa

SEQ ID NO: 46777 - DNA, 71 bp, chicken (Gallus Gallus)
  misc_feature (36): n=a or g
cctttcacaggtgcatgaaaaacaccattccccccnttactggagctcataatctgaggagatgcacatta

SEQ ID NO: 46778 - DNA, 71 bp, chicken (Gallus Gallus)
  misc_feature (36): n=a or g
aaagcttttctgtagttaaaattcgaaagatttagnatgcttgttcaggtctttgaatgaaaggtgctaaa

SEQ ID NO: 46779 - DNA, 71 bp, chicken (Gallus Gallus)
  misc_feature (36): n=c or t
cacctgcaagctgctcttgcccttgagtgtgccccngcaggattttgtttattcccttttcgcctccctga

SEQ ID NO: 46780 - DNA, 71 bp, chicken (Gallus Gallus)
  misc_feature (36): n=a or g
agaggtgatgtagaagcatgttgttttgacactaanttgtactttctgcctttaggaatgtgtaatgattt

SEQ ID NO: 46781 - DNA, 71 bp, chicken (Gallus Gallus)
  misc_feature (36): n=c or t
gcctcctcctattgcatggcataggaacacgctgcntgcctggcaccctggctgacctctcgttatgattt

SEQ ID NO: 46782 - DNA, 71 bp, chicken (Gallus Gallus)
  misc_feature (36): n=c or t
tgttttgtcttgacagtgtgtgttggaagcctgtgntttcgtcagcctggtgttccgtgtaatgcagaaga

SEQ ID NO: 46783 - DNA, 71 bp, chicken (Gallus Gallus)
  misc_feature (36): n=g or t
taccttcactgtttattagatagggtgatggtttanatcagttttacttaacctttaaccacttatttaaa

SEQ ID NO: 46784 - DNA, 71 bp, chicken (Gallus Gallus)
  misc_feature (36): n=c or t
agaactgtatatttgaaagcctgtttagttagctangaggtaggcaggatatgcagtgaagtacccgattc

SEQ ID NO: 46785 - DNA, 71 bp, chicken (Gallus Gallus)
  misc_feature (36): n=a or g
ggggagtagagcaaggtgcagaatggtgccatactnatcagtttcaggtggctgtttgtcctcagccctct

SEQ ID NO: 46786 - DNA, 71 bp, chicken (Gallus Gallus)
  misc_feature (36): n=a or g
attcatctgtcagctggaaaagctgatgcaccaccntcattcccacctgggctgccatgcagatctgcact

SEQ ID NO: 46787 - DNA, 71 bp, chicken (Gallus Gallus)
  misc_feature (36): n=a or g
gcacagtgcccagattaggccttagctccagcaaanacacgttgttggctgtatctgtagcgtcagctcac

SEQ ID NO: 46788 - DNA, 71 bp, chicken (Gallus Gallus)
  misc_feature (36): n=a or c
ttcttggctttgtgtattctcatctttaaccaaacnttttctctgaatgtgcctggtgctattgtcatata

SEQ ID NO: 46789 - DNA, 71 bp, chicken (Gallus Gallus)
  misc_feature (36): n=a or c
ttgtgtcagatctgaactagaagaaaagataaattnagcatccagtgatttcctgttgttttaagtagtag

SEQ ID NO: 46790 - DNA, 71 bp, chicken (Gallus Gallus)
  misc_feature (36): n=c or t
tttattctattctgattccctggaggaaattcctgnggaactggaggagtctgtcactcagtttccattcg

SEQ ID NO: 46791 - DNA, 71 bp, chicken (Gallus Gallus)
  misc_feature (36): n=a or g
tagtgtagaggaggaaccatagctgtctactctttnatttttaatttaatgttgaaaagatgtaactgaag

SEQ ID NO: 46792 - DNA, 71 bp, chicken (Gallus Gallus)
  misc_feature (36): n=a or g
cgatacaactgcccactgatcaaaggcccgctctcngtgcaatgtcttaccacctgccaactgatgtccag

SEQ ID NO: 46793 - DNA, 71 bp, chicken (Gallus Gallus)
  misc_feature (36): n=c or t
aaggccttacttggagaggtgaacagcaatccctgngtgtagcgatagcagtaagaattaaatagaggttt

SEQ ID NO: 46794 - DNA, 71 bp, chicken (Gallus Gallus)
  misc_feature (36): n=c or t
tatgtagacctcatagtgcttggatataataattantgcattggagagttcaaaaaatactgtttccttca

SEQ ID NO: 46795 - DNA, 71 bp, chicken (Gallus Gallus)
  misc_feature (36): n=c or t
ggcaaaggactgagtaaacagagcagaaaaaggttnctgcgtaaaaaggcctaaatatatagtcctactta

SEQ ID NO: 46796 - DNA, 71 bp, chicken (Gallus Gallus)
  misc_feature (36): n=a or g
tttcattgaggcttacggattgtttttatgtctcanaagctagaaacttgttcttaaaagcacagtataat

SEQ ID NO: 46797 - DNA, 71 bp, chicken (Gallus Gallus)
  misc_feature (36): n=a or g
gcaattacttataaacatttcaaaaagatttccccnaagaatgaaagctgattgttgcagaaaaataaata

SEQ ID NO: 46798 - DNA, 71 bp, chicken (Gallus Gallus)
  misc_feature (36): n=a or g
gaggaggacaggcctctgttaaggcacttattttgntaggaagaatgtgtcttacttctggggttgtaaaa

SEQ ID NO: 46799 - DNA, 71 bp, chicken (Gallus Gallus)
  misc_feature (36): n=c or t
tcccaagcagcccactgtatccctctacttatgagnggagaaaagaagatactgctctcatctgaaatcac

SEQ ID NO: 46800 - DNA, 71 bp, chicken (Gallus Gallus)
  misc_feature (36): n=c or t
atatttttctactgaatgggagtcagtacaacatgngtctagacatgcttgccacttgccactttctgcag

SEQ ID NO: 46801 - DNA, 71 bp, chicken (Gallus Gallus)
  misc_feature (36): n=c or t
actggcattccaaccagccagtctgtctaatcctcntcaaaatccatgctgtttttgccctcagcaacagc

SEQ ID NO: 46802 - DNA, 71 bp, chicken (Gallus Gallus)
  misc_feature (36): n=a or g
tagatcatctggtagttcagatgggacatgcctgtncttgttaatgtgagctgctctcttctaagcagagt

SEQ ID NO: 46803 - DNA, 71 bp, chicken (Gallus Gallus)
  misc_feature (36): n=g or t
ctgtttcagttcagatctagatctgagttatttacntatgtgtttaggtaagataatagaaaatatataac

SEQ ID NO: 46804 - DNA, 71 bp, chicken (Gallus Gallus)
  misc_feature (36): n=a or g
gtctgtgaaaactagggtgacagtgaagaagagggngaagttaaggtgaaatacggtgttataatttttta

SEQ ID NO: 46805 - DNA, 71 bp, chicken (Gallus Gallus)
  misc_feature (36): n=a or g
cccaaaactacggatgaacttaacatttgtttcatntatgtgcaagtcagtgggaatggtagtttagtgag

SEQ ID NO: 46806 - DNA, 71 bp, chicken (Gallus Gallus)
  misc_feature (36): n=a or g
tgagtcacagaggatttagaagcaaagctgtagatnctttctaaggaggaaattgtctcctcttaaaggag

SEQ ID NO: 46807 - DNA, 71 bp, chicken (Gallus Gallus)
  misc_feature (36): n=a or g
ggctagaaggccacctctgttgtgcctggtttgaancttagagtcccttggatttcacatcaccacacatc

SEQ ID NO: 46808 - DNA, 71 bp, chicken (Gallus Gallus)
  misc_feature (36): n=a or c
agagaaattcataaatgaaaaatccaatatgactcngcttatatgccaactgacacttatatgtccaaatg

SEQ ID NO: 46809 - DNA, 71 bp, chicken (Gallus Gallus)
  misc_feature (36): n=a or g
aatagtgttatttgatacatttttatcatctgtaanaagatacccagagagtcactcaagaaagcaaacaa

SEQ ID NO: 46810 - DNA, 71 bp, chicken (Gallus Gallus)
  misc_feature (36): n=a or g
ggcatgtgctcagggccaccccagagggatggagtnggccatgctgccacatgcatcattcacgtgcatca

SEQ ID NO: 46811 - DNA, 71 bp, chicken (Gallus Gallus)
  misc_feature (36): n=c or t
gcttgactccgaatcatgtcaaggatggtttcactngtatgcaattagcaacggtcgtaatcttttgaaaa

SEQ ID NO: 46812 - DNA, 71 bp, chicken (Gallus Gallus)
  misc_feature (36): n=c or t
ataccacgaagaggtttctctgctaactgacaaganattaaattacaatgtaatcttccaggaaaaactta

SEQ ID NO: 46813 - DNA, 71 bp, chicken (Gallus Gallus)
  misc_feature (36): n=c or t
gctttcaatcatgcaagtcatgcttcagctttaacnatattttatcatgctagctcattgagtatatagct

SEQ ID NO: 46814 - DNA, 71 bp, chicken (Gallus Gallus)
  misc_feature (36): n=a or c
gacttagcttgcaattgtctgccctagaaaaagaantgcaggtgaaagttcacaattctaacctcttacag

SEQ ID NO: 46815 - DNA, 71 bp, chicken (Gallus Gallus)
  misc_feature (36): n=a or g
gatggcataggtgtgagaaggctgctcttccttgtntgcatagaacaggaagcatatattgccaagacagc

SEQ ID NO: 46816 - DNA, 71 bp, chicken (Gallus Gallus)
  misc_feature (36): n=c or t
acaggtaagagcttgtagtggtgttggcattgttangtggccaagcgtctccctccctccctgtctgtact

SEQ ID NO: 46817 - DNA, 71 bp, chicken (Gallus Gallus)
  misc_feature (36): n=c or t
gaaagaatttcaaaccgttcaaggctcctgcatggncagcactgggggccttgctgtctttgcagaatgta

SEQ ID NO: 46818 - DNA, 71 bp, chicken (Gallus Gallus)
  misc_feature (36): n=c or t
tcccaatatttccaaccttgcacctaaaaattactncagccttttaaagctgattgtcatttcacctcctc

SEQ ID NO: 46819 - DNA, 71 bp, chicken (Gallus Gallus)
  misc_feature (36): n=c or t
ttattaggtttcctgaataaaattaaattcacgtanccagagactgaacatcactacagtgttctacttta

SEQ ID NO: 46820 - DNA, 71 bp, chicken (Gallus Gallus)
  misc_feature (36): n=a or g
agaacatggatgcacttgtgaaactgattttagtcntggtaaaaagcacgtaagatattcttaagagggaa

SEQ ID NO: 46821 - DNA, 71 bp, chicken (Gallus Gallus)
  misc_feature (36): n=a or c
tctaacgcagcagaaaagctgtgcagtcaggtctcnagagctattgtacgttgccaaagctgtactcttag

SEQ ID NO: 46822 - DNA, 71 bp, chicken (Gallus Gallus)
  misc_feature (36): n=c or t
aacacacataagctaaaacagtacttaatctgtatnatcagctcaggttagctcaaaatggaaattgcttt

SEQ ID NO: 46823 - DNA, 71 bp, chicken (Gallus Gallus)
  misc_feature (36): n=a or c
ttctgtattctaggtttagtttaatgagaatcattnagtatcgaagcactgtattgttactccatttcatg

SEQ ID NO: 46824 - DNA, 71 bp, chicken (Gallus Gallus)
  misc_feature (36): n=c or t
tacattactttgaaaaacttgagtgttgtaatcttngagattttcctatttctagtgacgttaggagtgat

SEQ ID NO: 46825 - DNA, 71 bp, chicken (Gallus Gallus)
  misc_feature (36): n=c or t
tctacaacccaaactctaccgctaactaatgcttcnacgtatgcatagtgcctcctggttgtcgcccgggt

SEQ ID NO: 46826 - DNA, 71 bp, chicken (Gallus Gallus)
  misc_feature (36): n=a or g
acagcaagtactgatttatgctctgctgtcagcacngagtaacgatctaaagctctctttcccacagtgta

SEQ ID NO: 46827 - DNA, 71 bp, chicken (Gallus Gallus)
  misc_feature (36): n=c or t
catctgtatgatgtaaacatttaataagagagacanagcattgaaagaaaataggaaagactttggtttaa

SEQ ID NO: 46828 - DNA, 71 bp, chicken (Gallus Gallus)
  misc_feature (36): n=a or g
aaatgtagtacatatatgttcatatatgtgcatgantataaagatatttcccaacaaggttagttttcttg

SEQ ID NO: 46829 - DNA, 71 bp, chicken (Gallus Gallus)
  misc_feature (36): n=c or t
caaaatggatgaagtagaaaaatttcctgatgttangatttctgcatttgtcaactggagtatagatagca

SEQ ID NO: 46830 - DNA, 71 bp, chicken (Gallus Gallus)
  misc_feature (36): n=a or g
taattgctatactaagcatctttgtgccatttgctntggatttgaactgcgtgtacagccctaaaatgtta

SEQ ID NO: 46831 - DNA, 71 bp, chicken (Gallus Gallus)
  misc_feature (36): n=g or t
ttgaagcctcaattaattaacccttgggctaagtangcaggtacatggtggtggccacaggcggtggatgg

SEQ ID NO: 46832 - DNA, 71 bp, chicken (Gallus Gallus)
  misc_feature (36): n=a or g
atcacgctcctgataccataatgatcacctcggacntgaggtcccacatacctctcctgactgagggccag

SEQ ID NO: 46833 - DNA, 71 bp, chicken (Gallus Gallus)
  misc_feature (36): n=c or t
caggcctgtttgcttgtgtgttgaatactctgccangtggctgtgtcactttggacctgaaaacacttctg

SEQ ID NO: 46834 - DNA, 71 bp, chicken (Gallus Gallus)
  misc_feature (36): n=c or t
acttcagttgctacaatttttttgatacttctattnagtactgtaattcacagaaaccttgaaaatgttga

SEQ ID NO: 46835 - DNA, 71 bp, chicken (Gallus Gallus)
  misc_feature (36): n=c or t
aaatggcttttcaggtgaactactgggatttttaangttgaaacatgaaagagcagatgcaaatttgagct

SEQ ID NO: 46836 - DNA, 71 bp, chicken (Gallus Gallus)
  misc_feature (36): n=c or t
gctcattccagtttaaaactggagttgttctgagcncacacctgaggatacatctcttcctgcctcccact

SEQ ID NO: 46837 - DNA, 71 bp, chicken (Gallus Gallus)
  misc_feature (36): n=c or t
atgaagagcagtagcagcaacaagcagaacaatctnatctgtggaactagtgggcctttctagctagatct

SEQ ID NO: 46838 - DNA, 71 bp, chicken (Gallus Gallus)
  misc_feature (36): n=c or t
taatgaggacccaagagcatcacacagacataatcngctgcaggatcttactagaggtcatacaatatcct

SEQ ID NO: 46839 - DNA, 71 bp, chicken (Gallus Gallus)
  misc_feature (36): n=g or t
taaatcacagtctacaatctagatatttgtggcttnagccagttttttctctcactggctcactgtctagt

SEQ ID NO: 46840 - DNA, 71 bp, chicken (Gallus Gallus)
  misc_feature (36): n=c or t
gcttggagaacttggccttcagtctggcagcagtgnacatcactcatctggggctggcagcagagcgtatt

SEQ ID NO: 46841 - DNA, 71 bp, chicken (Gallus Gallus)
  misc_feature (36): n=c or t
ctcacttagagggtttgccccaggctgtatctcaanccagcatcattttccttaaagctgtgaaagtaact

SEQ ID NO: 46842 - DNA, 71 bp, chicken (Gallus Gallus)
  misc_feature (36): n=a or g
acattctatcaccttcttccattgcgttgagctagnttttcaagtatgttccttttggtaaaaatatgcag

SEQ ID NO: 46843 - DNA, 71 bp, chicken (Gallus Gallus)
  misc_feature (36): n=a or g
cccctcaccatgaaccaggctggagccccaaatctncaaaatctttagggaagtactaatgcattgtgttt

SEQ ID NO: 46844 - DNA, 71 bp, chicken (Gallus Gallus)
  misc_feature (36): n=c or t
tttaaaaggaggtaagcaggaaaaccctgtcaaatncaaaaacattctgaaatctggtctgtattctctct

SEQ ID NO: 46845 - DNA, 71 bp, chicken (Gallus Gallus)
  misc_feature (36): n=c or t
cagtgagctcccaccagagatttcctgtgtccatancactgcctttgataaacaaggctgcattctgaaaa

SEQ ID NO: 46846 - DNA, 71 bp, chicken (Gallus Gallus)
  misc_feature (36): n=a or g
tgtgaacagctgaacctaagagactgcattcctaangttttcggaaaaaggctattaatgagatccttaga

SEQ ID NO: 46847 - DNA, 71 bp, chicken (Gallus Gallus)
  misc_feature (36): n=a or g
gatagaatttgaagagtacagtgcataacaagacantgtaattttttatcactgctgttgaggttcactcc

SEQ ID NO: 46848 - DNA, 71 bp, chicken (Gallus Gallus)
  misc_feature (36): n=c or t
atttaaacaaaacatacattcagatagccactgaanaatcttatcacctgttataccagtgttactgtgta

SEQ ID NO: 46849 - DNA, 71 bp, chicken (Gallus Gallus)
  misc_feature (36): n=a or g
ggagaacctagaacagctggcactttcttccagtcnctaccaaaataacacacaccttaaaacactaagtg

SEQ ID NO: 46850 - DNA, 71 bp, chicken (Gallus Gallus)
  misc_feature (36): n=g or t
ttttaaaagatccaaagatcatctattctataaatngaggtataaatgattctaacatcttaaagcaagct

SEQ ID NO: 46851 - DNA, 71 bp, chicken (Gallus Gallus)
  misc_feature (36): n=a or g
ttcatggaagttcgtgtagccagtagaaacttacanctcttcaactacagaaattcagatatttcccatct

SEQ ID NO: 46852 - DNA, 71 bp, chicken (Gallus Gallus)
  misc_feature (36): n=c or t
acatcatccgattactcaggtaagtcagaattatgnttgtaatagtattgttaatgttatattgtataaat

SEQ ID NO: 46853 - DNA, 71 bp, chicken (Gallus Gallus)
  misc_feature (36): n=c or t
tcttgaaaagttaaaagtatacaactaccacactantggcattacacaaatagataatgtgagtaacgaaa

SEQ ID NO: 46854 - DNA, 71 bp, chicken (Gallus Gallus)
  misc_feature (36): n=a or c
ttttatagcatatgaaagcatactctactgagatgnaagagcaagcaacatagagaaattatttaatttca

SEQ ID NO: 46855 - DNA, 71 bp, chicken (Gallus Gallus)
  misc_feature (36): n=a or g
gtgtgcagactgtaaagccatcgaattccaacaacncagtagtatttgagagctctggcttagaacaagat

SEQ ID NO: 46856 - DNA, 71 bp, chicken (Gallus Gallus)
  misc_feature (36): n=a or g
tacagatgaggatgaatatgagtacatttgatggantgttgggcactgtgctttccatggaatatttcccc

SEQ ID NO: 46857 - DNA, 71 bp, chicken (Gallus Gallus)
  misc_feature (36): n=c or t
gactggatagcacattacaagctgaagtctggcaangcttttcaaactaacatgaatggatagtgctagtt

SEQ ID NO: 46858 - DNA, 71 bp, chicken (Gallus Gallus)
  misc_feature (36): n=c or t
agttcatgtgattgagagcatggggcagtgagcagnggactttgataaggctgagcttggatagaacaaat

SEQ ID NO: 46859 - DNA, 71 bp, chicken (Gallus Gallus)
  misc_feature (36): n=g or t
catttctgttctgagcaaagaatcagctgaactggncagaaatgcttctcaggaaattattatctcttgtg

SEQ ID NO: 46860 - DNA, 71 bp, chicken (Gallus Gallus)
  misc_feature (36): n=g or t
ggcaacccaaaatgcccatcacttcagttctacagngtcatctgtgagattccctgttgcgtatagtacat

SEQ ID NO: 46861 - DNA, 71 bp, chicken (Gallus Gallus)
  misc_feature (36): n=c or t
gaaaatcttgatttatataatattgtgaagtattanctgattagagtttaatgctctgtgaggttaaatta

SEQ ID NO: 46862 - DNA, 71 bp, chicken (Gallus Gallus)
  misc_feature (36): n=a or g
gtgtaggctaccacactccagtgagtaccttcatcntagatcccaagtagtgcttatcttctctccgtgtt

SEQ ID NO: 46863 - DNA, 71 bp, chicken (Gallus Gallus)
  misc_feature (36): n=a or g
tttcaagaataaggacccatgacttacttgcatttncctgatttatttacctcacttctgatttctgctga

SEQ ID NO: 46864 - DNA, 71 bp, chicken (Gallus Gallus)
  misc_feature (36): n=a or g
tcagaaaataggcttgttgatacaagtttgatgctncatgtactcgatatcataagcttgtagtctatcgg

SEQ ID NO: 46865 - DNA, 71 bp, chicken (Gallus Gallus)
  misc_feature (36): n=a or g
agcgacctggaattaatattgataaccaaaattctngtttgctaaatgcagcaaaattgtacgttgtgtct

SEQ ID NO: 46866 - DNA, 71 bp, chicken (Gallus Gallus)
  misc_feature (36): n=a or g
gatgttggtcctatgcccaggagaggaggttggagnatgggaataatggaattcccctcgttgcctccatg

SEQ ID NO: 46867 - DNA, 71 bp, chicken (Gallus Gallus)
  misc_feature (36): n=a or g
gagaatcaggactttttcctcgatccgagcatagcntgtagattgatacttatattttcacgactggaaaa

SEQ ID NO: 46868 - DNA, 71 bp, chicken (Gallus Gallus)
  misc_feature (36): n=a or c
acaagccaggtgcacaggcatatacccctctgtccnctcacctgtgagccaagtgcaattattctactttc

SEQ ID NO: 46869 - DNA, 71 bp, chicken (Gallus Gallus)
  misc_feature (36): n=a or g
ttcgtctgctcttttgcttccccagtagtatctccntggtgctttatgtgtctgccacaagctggacgaac

SEQ ID NO: 46870 - DNA, 71 bp, chicken (Gallus Gallus)
  misc_feature (36): n=c or t
cctcaccttgagacattccttaaccaagttttgagncaaaaaaaaagctactatgaatatttctcatgggc

SEQ ID NO: 46871 - DNA, 71 bp, chicken (Gallus Gallus)
  misc_feature (36): n=g or t
cctacttacattgaataatttgactcaggtatacancatttcattttctatagccattgtgttcttggttg

SEQ ID NO: 46872 - DNA, 71 bp, chicken (Gallus Gallus)
  misc_feature (36): n=c or t
ctctgctgcaaacacattcagatacttttatgctangtccttaggccgtgacagatgtctaggtagccaaa

SEQ ID NO: 46873 - DNA, 71 bp, chicken (Gallus Gallus)
  misc_feature (36): n=a or g
gtcatttggctgccttctcagatagctcccattgancaaattcccaccatgggaaatgcacatcacagtga

SEQ ID NO: 46874 - DNA, 71 bp, chicken (Gallus Gallus)
  misc_feature (36): n=a or g
catgcccaggaaagttcccgtctctgcctgacaccntgtcagtgcagacaactatgaatggcagcaccacc

SEQ ID NO: 46875 - DNA, 71 bp, chicken (Gallus Gallus)
  misc_feature (36): n=c or t
agaacgataatcaattctataaaggctttttgcccntcccagtatctcactcccctatgtaattgacttaa

SEQ ID NO: 46876 - DNA, 71 bp, chicken (Gallus Gallus)
  misc_feature (36): n=c or t
tttcaccaagttatttcctcgggacgaactcactanaaagccattccttgccagaatgacgtgacatagaa

SEQ ID NO: 46877 - DNA, 71 bp, chicken (Gallus Gallus)
  misc_feature (36): n=c or t
tacccactgcagtaaaaagcttgcagaccttggtgnccagcaagaaactcatctcactgggatgttggcat

SEQ ID NO: 46878 - DNA, 71 bp, chicken (Gallus Gallus)
  misc_feature (36): n=a or g
ttatatatgttatattccctcacaaacttggattanagcagtaaccaatatacacagaaagagaaggaatt

SEQ ID NO: 46879 - DNA, 71 bp, chicken (Gallus Gallus)
  misc_feature (36): n=a or c
cctgtaggccttggttatcttcctccagaaagaccnagttttacctcactgctttacttgctatgagcaat

SEQ ID NO: 46880 - DNA, 71 bp, chicken (Gallus Gallus)
  misc_feature (36): n=a or g
cttgcagtgtatgatatagaaacaccaattaattanggttaacttaggcaaaatgaagcaacctgcaagct

SEQ ID NO: 46881 - DNA, 71 bp, chicken (Gallus Gallus)
  misc_feature (36): n=g or t
gcaaagatgtgggaaggagcttgcagtaacacaganagtttagtggatgtgagagggagctagaaatactc

SEQ ID NO: 46882 - DNA, 71 bp, chicken (Gallus Gallus)
  misc_feature (36): n=c or t
agtctcctgttcagacttaatcttagaatgtgcttntgtaccatcacttctcactatctgaaatgaagcct

SEQ ID NO: 46883 - DNA, 71 bp, chicken (Gallus Gallus)
  misc_feature (36): n=a or g
tggccactggggattactttcacttttcctctctcnctgtaagtgttgctaacatgtcttcataaaggatt

SEQ ID NO: 46884 - DNA, 71 bp, chicken (Gallus Gallus)
  misc_feature (36): n=a or g
aaatttagtggagtgctatgaagatggaaggaaatntgccaggagacccgtactagaaggggtctggcagt

SEQ ID NO: 46885 - DNA, 71 bp, chicken (Gallus Gallus)
  misc_feature (36): n=a or g
tacggtggaacatccattaagttcatcgccaatcgnacttccttagaattgctttttgtgcgtctggactg

SEQ ID NO: 46886 - DNA, 71 bp, chicken (Gallus Gallus)
  misc_feature (36): n=c or t
acaacaactgtatgttgttgcttctctcagaacctnaatactgtctcaccactcattaaattatggtcttc

SEQ ID NO: 46887 - DNA, 71 bp, chicken (Gallus Gallus)
  misc_feature (36): n=c or t
agatatgacagttggcagaggggctatcaggagaanaagaaagaaagaaaaaaaaagatacttagaagaga

SEQ ID NO: 46888 - DNA, 71 bp, chicken (Gallus Gallus)
  misc_feature (36): n=g or t
aactgcctccagtttattgtcattctaccaccatanttttgcatttatacattattgacttcagaaagttt

SEQ ID NO: 46889 - DNA, 71 bp, chicken (Gallus Gallus)
  misc_feature (36): n=a or g
atacccaacagaactgctcccaagagaggagtggtnctcacactaccaggtatgctgcatgtcctgagcta

SEQ ID NO: 46890 - DNA, 71 bp, chicken (Gallus Gallus)
  misc_feature (36): n=g or t
aaatgggaagtcaaggaccagtatctgtcagatttnggccacaaatgagctgtgcctgtgtttctagtaca

SEQ ID NO: 46891 - DNA, 71 bp, chicken (Gallus Gallus)
  misc_feature (36): n=c or t
ttaatcaggcatcttccatctcacagccaccacctngtcaagaatgtcatgaggacaagatagctctgaca

SEQ ID NO: 46892 - DNA, 71 bp, chicken (Gallus Gallus)
  misc_feature (36): n=c or t
tgcaagttatcagtaacaaacatcacacagtgactnccaaatgtgaaaatgtaataaagctgtgccattaa

SEQ ID NO: 46893 - DNA, 71 bp, chicken (Gallus Gallus)
  misc_feature (36): n=c or t
taggagacacaaattaactgccaccttaaagaagangcattaagctgataagaagatggtgttcctaatgg

SEQ ID NO: 46894 - DNA, 71 bp, chicken (Gallus Gallus)
  misc_feature (36): n=c or t
aatacagattgtcttttagctagtttccctctagtnccaactccaaatagagaaatggcttttttttcttc

SEQ ID NO: 46895 - DNA, 71 bp, chicken (Gallus Gallus)
  misc_feature (36): n=g or t
ctgtgctgtgtgataaacgcaaaagaataatgggantagacttgaaggttaggtttgaaacaaaactttag

SEQ ID NO: 46896 - DNA, 71 bp, chicken (Gallus Gallus)
  misc_feature (36): n=c or t
aatgcagtattcaccacagaatcgatagtacctttntgctacatttcctagcaatttctctgcatttgttt

SEQ ID NO: 46897 - DNA, 71 bp, chicken (Gallus Gallus)
  misc_feature (36): n=a or g
agatatcagagccatttttgcgctgctggctaaaancatcacgctttattttctattgtaatggtctgtgc

SEQ ID NO: 46898 - DNA, 71 bp, chicken (Gallus Gallus)
  misc_feature (36): n=a or g
ataatgtagcataataagtggaatcagttttatttntaagaggaaagcctcccatttattaaaaagctatc

SEQ ID NO: 46899 - DNA, 71 bp, chicken (Gallus Gallus)
  misc_feature (36): n=c or t
atatagcagcttggagagggaaagctgctatatccntcctcagttgactctcacttttgggttaaataaac

SEQ ID NO: 46900 - DNA, 71 bp, chicken (Gallus Gallus)
  misc_feature (36): n=a or g
cagacaaacttacaagtactgcacgaattgcttatntttttcactgatatgactccctaagattatcatga

SEQ ID NO: 46901 - DNA, 71 bp, chicken (Gallus Gallus)
  misc_feature (36): n=a or g
aaaaaaattttgtcaataccacagtgctgcacagtnagttgttaatacacaaaaactattcagtcttcttc

SEQ ID NO: 46902 - DNA, 71 bp, chicken (Gallus Gallus)
  misc_feature (36): n=a or c
ttgtgtctctgctgcttgatgaggaggagggactgnagtctcagaaagtcttctgaaaacccaatattgag

SEQ ID NO: 46903 - DNA, 71 bp, chicken (Gallus Gallus)
  misc_feature (36): n=g or t
ttgcataaggttgtaccaagagcccagacgttctcngttacaagacgaggcctgcccaggcaccagcggag

SEQ ID NO: 46904 - DNA, 71 bp, chicken (Gallus Gallus)
  misc_feature (36): n=g or t
caggcataggctctaatgtgagtgtgatccagtctncagttggctcaccatggacacatgggactctgacc

SEQ ID NO: 46905 - DNA, 71 bp, chicken (Gallus Gallus)
  misc_feature (36): n=a or g
tttaaaaattctctgttcctaagttgagtcacgttncttaaacaatactgactggaggaaaacacctcaat

SEQ ID NO: 46906 - DNA, 71 bp, chicken (Gallus Gallus)
  misc_feature (36): n=c or t
actgtacacggtagtcctggagatggtagttggctncaatcatgagctcaaatcaacaggtaagttcctgg

SEQ ID NO: 46907 - DNA, 71 bp, chicken (Gallus Gallus)
  misc_feature (36): n=c or t
cataaaggaagctttagagacttggtttttcagtanatgttcaaattcagtgttgaacctctcccactgga

SEQ ID NO: 46908 - DNA, 71 bp, chicken (Gallus Gallus)
  misc_feature (36): n=a or g
tccaaatgtgtatctttttctgggcagccagcaatngaacccatacttttccctacttctgacttggaacg

SEQ ID NO: 46909 - DNA, 71 bp, chicken (Gallus Gallus)
  misc_feature (36): n=a or c
gttcatccttaatacctccaaactcccagctgcccnactaagcaccagcagcattacttggcatttacatt

SEQ ID NO: 46910 - DNA, 71 bp, chicken (Gallus Gallus)
  misc_feature (36): n=a or c
ccgtctgcatcaaatgtgaggtacttcagtatgagnaaagtgttgataaacttagcaagctcagctgggat

SEQ ID NO: 46911 - DNA, 71 bp, chicken (Gallus Gallus)
  misc_feature (36): n=a or g
gtaggagagattttttgccctttaagatttgttcantctgttaaaatcctagtctttttaatcgtgggtat

SEQ ID NO: 46912 - DNA, 71 bp, chicken (Gallus Gallus)
  misc_feature (36): n=c or t
gctgtaactcacttcccaccaagaataaccaatatncaagtgctgacattagaaatccaagttcacgtttc

SEQ ID NO: 46913 - DNA, 71 bp, chicken (Gallus Gallus)
  misc_feature (36): n=c or t
gaaaggcacttggcactcctcagcttcaggcttagnaacacaccacttcttgagaatggacagttagcata

SEQ ID NO: 46914 - DNA, 71 bp, chicken (Gallus Gallus)
  misc_feature (36): n=c or t
agtttggcaaaccgtctagagtccagttcaggtganagtgagagctttacagtaagttcacctgcctagat

SEQ ID NO: 46915 - DNA, 71 bp, chicken (Gallus Gallus)
  misc_feature (36): n=c or t
ttagcatacatggaatcacaaggtgctcatagggcnggagttgcaaaggtaaacatctttaatataggcga

SEQ ID NO: 46916 - DNA, 71 bp, chicken (Gallus Gallus)
  misc_feature (36): n=c or t
caaattggaaaatgctatttctacattatcaccagntctgggaagatggaggaatattctgttacaattac

SEQ ID NO: 46917 - DNA, 71 bp, chicken (Gallus Gallus)
  misc_feature (36): n=a or g
acagtatatgattgagtgatttcctttattttgtcnagtttctgtgtgaataaaagacactgatcttatta

SEQ ID NO: 46918 - DNA, 71 bp, chicken (Gallus Gallus)
  misc_feature (36): n=c or t
acggcagtccaaatgtactaagaaggtaagcaacanagagtaagagaaggatggagggcagttgatgtgca

SEQ ID NO: 46919 - DNA, 71 bp, chicken (Gallus Gallus)
  misc_feature (36): n=a or g
cttcagcataagcttatacaggatgggatggactanggaaaaaggcttaagatactggtgttcatcgtact

SEQ ID NO: 46920 - DNA, 71 bp, chicken (Gallus Gallus)
  misc_feature (36): n=a or g
cagttaaacaggggtaggcagccccacagctcatcngaaacttgtgttaatttcctttcaggggtgataga

SEQ ID NO: 46921 - DNA, 71 bp, chicken (Gallus Gallus)
  misc_feature (36): n=a or g
tttatgtatctgaaaatgtctttacacagatgaatncaaacactcagtgtgttatcagcataatcagttag

SEQ ID NO: 46922 - DNA, 71 bp, chicken (Gallus Gallus)
  misc_feature (36): n=a or g
atgtcagtagcctacagctgaaacttttgtttgtcngtagctgaaaaatgtcagggaacttgaagctgttt

SEQ ID NO: 46923 - DNA, 71 bp, chicken (Gallus Gallus)
  misc_feature (36): n=c or t
aaaggcttgagatctttttgacgatcccagcttcangccatactttccaatgcaaattacctctgaagtca

SEQ ID NO: 46924 - DNA, 71 bp, chicken (Gallus Gallus)
  misc_feature (36): n=g or t
cttctcttcttttgtaaagatagatgtctatctacnttcacttgggtttaagtactgtgactatacaaagc

SEQ ID NO: 46925 - DNA, 71 bp, chicken (Gallus Gallus)
  misc_feature (36): n=a or g
ttcttggcctaatacatagttcaaaacacagctaanctaacaacattgaattgtagtggttaatagttcat

SEQ ID NO: 46926 - DNA, 71 bp, chicken (Gallus Gallus)
  misc_feature (36): n=a or g
aatatctatggcacccactaagccacatggcagtanattccacactgtcccatgaattctcccaacatcca

SEQ ID NO: 46927 - DNA, 71 bp, chicken (Gallus Gallus)
  misc_feature (36): n=a or g
gatcaatactttctgtcaccacggttcgacatgacnaggtgaatagaataactagtaatcaaaagtaactt

SEQ ID NO: 46928 - DNA, 71 bp, chicken (Gallus Gallus)
  misc_feature (36): n=a or g
gaggtcactcttcatcccctggaattggaaactgcntgtggatactagagaattctgggaactgtagtctg

SEQ ID NO: 46929 - DNA, 71 bp, chicken (Gallus Gallus)
  misc_feature (36): n=a or c
tcattcaatttctggaagagtctccattcaagatancttgtgtaattctactacctactaatggtagtagg

SEQ ID NO: 46930 - DNA, 71 bp, chicken (Gallus Gallus)
  misc_feature (36): n=a or g
tattgaggcatttgactccactgggttcctgatacnttcttctttggagtgtgtcagcaaagtgttttact

SEQ ID NO: 46931 - DNA, 71 bp, chicken (Gallus Gallus)
  misc_feature (36): n=c or t
gttcctacagaggtttcacaaacccagaaggagaangaagtactattcctagtactgcaggtgctctgttt

SEQ ID NO: 46932 - DNA, 71 bp, chicken (Gallus Gallus)
  misc_feature (36): n=c or t
tccttgctttctcagatgttacccctttatctaaanctacagacaatatcttcaagagctctcacatgttc

SEQ ID NO: 46933 - DNA, 71 bp, chicken (Gallus Gallus)
  misc_feature (36): n=c or t
agactttacattgtctatagttacatatgcttaacnagaaataaaggagtgaaatgattttgctgcttttg

SEQ ID NO: 46934 - DNA, 71 bp, chicken (Gallus Gallus)
  misc_feature (36): n=a or g
ctgaaatctctactttcacaattcacaggtactgtngtgcttggaagcaaccactcatcctttatctcctt

SEQ ID NO: 46935 - DNA, 71 bp, chicken (Gallus Gallus)
  misc_feature (36): n=a or g
tccatatttgaatttatcactgctaagattacctgnaataaaagctgctgtcaagtaagaaaaagcacaaa

SEQ ID NO: 46936 - DNA, 71 bp, chicken (Gallus Gallus)
  misc_feature (36): n=c or t
tgttgtgtttaattgtatagaagtacagcacaaggnacggtagcatattatgacatgtgctctagtgttat

SEQ ID NO: 46937 - DNA, 71 bp, chicken (Gallus Gallus)
  misc_feature (36): n=a or g
ttgctctgtgctcttagagttcatcaatctcaaatnctaagcctcatcagctcaaagaaaaagaaatgcat

SEQ ID NO: 46938 - DNA, 71 bp, chicken (Gallus Gallus)
  misc_feature (36): n=a or g
ccttagcataatattttgtgttaggctacaggaaanaaaaatgagtactatgagcctatcaatttttgtaa

SEQ ID NO: 46939 - DNA, 71 bp, chicken (Gallus Gallus)
  misc_feature (36): n=c or t
tcttttcttgtagttctgacctctgaacaggactcnataaaaccttatttatccagaatttactaaaatat

SEQ ID NO: 46940 - DNA, 71 bp, chicken (Gallus Gallus)
  misc_feature (36): n=g or t
aaacaaatatgcaaggaaaatgaaatacgatctttnttcagaattacattttataatttgttgtgagacag

SEQ ID NO: 46941 - DNA, 71 bp, chicken (Gallus Gallus)
  misc_feature (36): n=c or t
ctgattctttggcatttgcagaactgtacagaatangtaggaaaagacctagcaggttatggaatgtgagt

SEQ ID NO: 46942 - DNA, 71 bp, chicken (Gallus Gallus)
  misc_feature (36): n=a or g
gcattctccagcttactacatggaggcccaagaganctctgttcttagtccaggcacctcaggtatcttta

SEQ ID NO: 46943 - DNA, 71 bp, chicken (Gallus Gallus)
  misc_feature (36): n=a or g
cttggcttatctgaacctagctagaaagtagagaancaactcagtggaaaatatgatgatctatacgattc

SEQ ID NO: 46944 - DNA, 71 bp, chicken (Gallus Gallus)
  misc_feature (36): n=a or c
gtattttatataattgctctattgttcttaaaaaanacatgtttttaaggttgttgtcatagtctaggaca

SEQ ID NO: 46945 - DNA, 71 bp, chicken (Gallus Gallus)
  misc_feature (36): n=c or t
taggaaagtaaactttaggtgagtgttacttctacncgctagtcacatacaatcttaattgaatcacaaag

SEQ ID NO: 46946 - DNA, 71 bp, chicken (Gallus Gallus)
  misc_feature (36): n=a or c
ctttttccttccaccagaagttggcagtagccctgnaaatataccaatcaaatatgccatttgttcactaa

SEQ ID NO: 46947 - DNA, 71 bp, chicken (Gallus Gallus)
  misc_feature (36): n=g or t
caaaacattttttgacttcttatgatagctgaaatntcatagttctttgtgttactgcttgcatagtaata

SEQ ID NO: 46948 - DNA, 71 bp, chicken (Gallus Gallus)
  misc_feature (36): n=g or t
ttttccaccaagaagcagatgcatacaagtgttganattcctgaacaaacagtagactgaaactcattcag

SEQ ID NO: 46949 - DNA, 71 bp, chicken (Gallus Gallus)
  misc_feature (36): n=c or t
cttccctttcactccattggtattgagattccttangaaatccttttaggaatccaggtaacctacagcaa

SEQ ID NO: 46950 - DNA, 71 bp, chicken (Gallus Gallus)
  misc_feature (36): n=c or t
aaacaaaaccccacagctgtaaacagagaggacagntctccttttcacaactaatttttggcatttcagaa

SEQ ID NO: 46951 - DNA, 71 bp, chicken (Gallus Gallus)
  misc_feature (36): n=a or g
gtattttaaataaagatttcattctgccaacccgcnggaagcttttaacaagatgcagctgagcgtgtcga

SEQ ID NO: 46952 - DNA, 71 bp, chicken (Gallus Gallus)
  misc_feature (36): n=c or t
ttaattagaagttatactaacagagagggagtgtanttatatgtaaatccaacataatcctagctattttg

SEQ ID NO: 46953 - DNA, 71 bp, chicken (Gallus Gallus)
  misc_feature (36): n=c or t
cagctggatctcagttggagtggcctcatcaatggnttagatctatttcaggggacaggcactgtgattca

SEQ ID NO: 46954 - DNA, 71 bp, chicken (Gallus Gallus)
  misc_feature (36): n=a or g
ataatatagttgtgtttctgactagtatttatggtnttttttttcttatactcactgtctttgaaaaatct

SEQ ID NO: 46955 - DNA, 71 bp, chicken (Gallus Gallus)
  misc_feature (36): n=a or g
tgaatcttacaaccaaacactatactgcacacacantgcaatagtttcctattttgctattttaacatgaa

SEQ ID NO: 46956 - DNA, 71 bp, chicken (Gallus Gallus)
  misc_feature (36): n=c or t
ggtgttgtagcagaaatactatttcattatatctcngatcaattcaggtttcacatcacataacatagttt

SEQ ID NO: 46957 - DNA, 71 bp, chicken (Gallus Gallus)
  misc_feature (36): n=a or g
ctatgttgttctgccccataaggaggaactggatgncactttataaaccatgagcaggtacacctgataac

SEQ ID NO: 46958 - DNA, 71 bp, chicken (Gallus Gallus)
  misc_feature (36): n=a or g
cttagataattagggacttcattttagctactattntgcttatagaaactttttgtattgcatagttcagc

SEQ ID NO: 46959 - DNA, 71 bp, chicken (Gallus Gallus)
  misc_feature (36): n=a or g
aaagagtgatcacttgcaaaatccagctaatcaacnttttagcttatttgatatgaatattttgaatatat

SEQ ID NO: 46960 - DNA, 71 bp, chicken (Gallus Gallus)
  misc_feature (36): n=a or g
gtataatttaagtcaattcaactggagagaaagcanccagtaatccctggtaagcataaagacagcaacac

SEQ ID NO: 46961 - DNA, 71 bp, chicken (Gallus Gallus)
  misc_feature (36): n=a or g
ctaaagggaaaacaatgaaagagaggctcaaatccncatatgcaaaaccttgcaaagaagtgcatgagttt

SEQ ID NO: 46962 - DNA, 71 bp, chicken (Gallus Gallus)
  misc_feature (36): n=a or g
gtaactactttgtagggaaggaacctgctgttctcnctgcaggacagtaaatgccctacaagagaagtgga

SEQ ID NO: 46963 - DNA, 71 bp, chicken (Gallus Gallus)
  misc_feature (36): n=c or t
aattctatttttcctcttcatgaaacttttcattantgtagcatattttctattagagactattctctgtt

SEQ ID NO: 46964 - DNA, 71 bp, chicken (Gallus Gallus)
  misc_feature (36): n=g or t
acaaattcacagagatccagaacaatgcaaaagtgntcaaaaccagatgcccaggaagagagcaaaatagc

SEQ ID NO: 46965 - DNA, 71 bp, chicken (Gallus Gallus)
  misc_feature (36): n=a or c
tcccttacctacagacaatttatgccactacttttnttttctacgctctttgttatttattagcaccaatt

SEQ ID NO: 46966 - DNA, 71 bp, chicken (Gallus Gallus)
  misc_feature (36): n=c or t
gaccacttttgcatggttcgtctcaacaacggaaanaacttcttgtggctctgccttcacaaaagactagt

SEQ ID NO: 46967 - DNA, 71 bp, chicken (Gallus Gallus)
  misc_feature (36): n=a or g
cctaccagagtaacttaattcaatttgaaggtgagnaaaatcataaacaacagaagtaaagtgatactctt

SEQ ID NO: 46968 - DNA, 71 bp, chicken (Gallus Gallus)
  misc_feature (36): n=c or t
agttggctgagctgcagctgtataacttcagatggngaggaggtttcaggcacagtttgcagtggattcat

SEQ ID NO: 46969 - DNA, 71 bp, chicken (Gallus Gallus)
  misc_feature (36): n=a or g
ttgaatgtgttatttagtatccctgacttacaaganggagtttaaacacgttttgagtaaatttctaattc

SEQ ID NO: 46970 - DNA, 71 bp, chicken (Gallus Gallus)
  misc_feature (36): n=a or c
agtcctttatctgtcacagaatgagttcatcaaacnaagtatacttgctcagtattagggtcttgactgtc

SEQ ID NO: 46971 - DNA, 71 bp, chicken (Gallus Gallus)
  misc_feature (36): n=a or g
tgaagccttctgaagcacgtccgtatgagacaatgntcctccaggatcaccagaaggaaacattttaccaa

SEQ ID NO: 46972 - DNA, 71 bp, chicken (Gallus Gallus)
  misc_feature (36): n=c or t
ttaacactgctcaaagattactggcaataaataagngagagctaagcaaagttaaaataaaggactggatg

SEQ ID NO: 46973 - DNA, 71 bp, chicken (Gallus Gallus)
  misc_feature (36): n=c or t
cagccgattgcttaggcccagaagagcatcctgacntctgcaatagcctgtggactatgaacagatacagt

SEQ ID NO: 46974 - DNA, 71 bp, chicken (Gallus Gallus)
  misc_feature (36): n=a or g
ctgaagtactctgcattagtgataaacaactctgancaagctttttctatgctgcaaagtttttggaaaac

SEQ ID NO: 46975 - DNA, 71 bp, chicken (Gallus Gallus)
  misc_feature (36): n=a or g
tgtttgcaaagagatctttccttttcatcctgcttncagccttgctttcataagccagagccctcattctt

SEQ ID NO: 46976 - DNA, 71 bp, chicken (Gallus Gallus)
  misc_feature (36): n=c or t
atcataagataagcatgaacaaacagcttatagtcncagacatcaagccaaattgtgctgcagttaattta

SEQ ID NO: 46977 - DNA, 71 bp, chicken (Gallus Gallus)
  misc_feature (36): n=c or t
aaagaaaaaatgctttaagtgaatttatgttttacncatagccaactcaagcatacgtggtggcctgcttg

SEQ ID NO: 46978 - DNA, 71 bp, chicken (Gallus Gallus)
  misc_feature (36): n=a or g
tgtggttgaagtaaccacttatacacataaagaacntgggtgggattgtcaagaacaggctgaataatcac

SEQ ID NO: 46979 - DNA, 71 bp, chicken (Gallus Gallus)
  misc_feature (36): n=g or t
tcacacagtcactgaaaacataaacaacaaatacanttttcaaagactactgccatggatatgctataagg

SEQ ID NO: 46980 - DNA, 71 bp, chicken (Gallus Gallus)
  misc_feature (36): n=c or t
aagcaaggcagtctgatcccacactcatgaaaggantgtggaccaactactcagtgaccgctgcctgaaaa

SEQ ID NO: 46981 - DNA, 71 bp, chicken (Gallus Gallus)
  misc_feature (36): n=c or t
tgaaaataaaaggctaaacctaaagatcccagcctncagaagcctatcatccagcactatacaatgagatg

SEQ ID NO: 46982 - DNA, 71 bp, chicken (Gallus Gallus)
  misc_feature (36): n=a or g
ctcaggatcttgggaacttcttagattcccagtcangggcaagttcagccctatatctgaagagatccatt

SEQ ID NO: 46983 - DNA, 71 bp, chicken (Gallus Gallus)
  misc_feature (36): n=a or g
agagaagaactagtttagtccactgtaagtgctctnttgttccccagaggacagttgctggtgatgtgcat

SEQ ID NO: 46984 - DNA, 71 bp, chicken (Gallus Gallus)
  misc_feature (36): n=c or t
tccagtgctgtgattgatatcagagtaaactgtaanactttaaaacagtgcacatacatatctttcctcag

SEQ ID NO: 46985 - DNA, 71 bp, chicken (Gallus Gallus)
  misc_feature (36): n=a or g
tttatgcatttttgtgatcctataactgcataatgncactaagaataacgtaaattgtcatgtcatttccg

SEQ ID NO: 46986 - DNA, 71 bp, chicken (Gallus Gallus)
  misc_feature (36): n=c or t
ggagatcagtgatatttgtgttctcttattttttgncatctaaccctaccatgaaacttttccaccgatct

SEQ ID NO: 46987 - DNA, 71 bp, chicken (Gallus Gallus)
  misc_feature (36): n=a or g
aagattcgtaaccatctaacatcagttgtttatganccatcgcattcctgtttatctcagccgttcaacct

SEQ ID NO: 46988 - DNA, 71 bp, chicken (Gallus Gallus)
  misc_feature (36): n=c or t
tttttcactaagaaacaagcatgtgctttcaggaanatctttgtcatttcgtcccatctgttaggtacata

SEQ ID NO: 46989 - DNA, 71 bp, chicken (Gallus Gallus)
  misc_feature (36): n=a or g
cctgggctgcaagaagctggctgtgtgtgagctgcnctgcctgaagggcaaagcagaagtgcagagccagg

SEQ ID NO: 46990 - DNA, 71 bp, chicken (Gallus Gallus)
  misc_feature (36): n=a or g
ctctgaggccaatatctgtttctgtcccagaggccnccagtggaggatcgctggtacagccaaggaatggc

SEQ ID NO: 46991 - DNA, 71 bp, chicken (Gallus Gallus)
  misc_feature (36): n=c or t
tacttatcagaaataatatttcataggaaaacttcnaggctaactatctgatcccagaccattagtgttaa

SEQ ID NO: 46992 - DNA, 71 bp, chicken (Gallus Gallus)
  misc_feature (36): n=c or t
tatcattattagtatttgctcagtacagtaatcttnagtaagaattctgatgtaatgtctactgaataatg

SEQ ID NO: 46993 - DNA, 71 bp, chicken (Gallus Gallus)
  misc_feature (36): n=c or t
cttctcggctccaaagaagaaattaatgggctccantgcttgttattcagtttccagttaaaaacttgttg

SEQ ID NO: 46994 - DNA, 71 bp, chicken (Gallus Gallus)
  misc_feature (36): n=a or c
aactagcaacgcagtgttagggtcagaatacatagnattcactctgtgaactgcattgaaacaactgaatt

SEQ ID NO: 46995 - DNA, 71 bp, chicken (Gallus Gallus)
  misc_feature (36): n=a or g
tgaagcagatacttacaggtagcagcattacttcgngaggctgagcacaagatcatgctgtatgaaaggaa

SEQ ID NO: 46996 - DNA, 71 bp, chicken (Gallus Gallus)
  misc_feature (36): n=g or t
gatttattcctagagcagctgaagatgaaattccanctgtattatttcccttcatagaaacagctgtgagt

SEQ ID NO: 46997 - DNA, 71 bp, chicken (Gallus Gallus)
  misc_feature (36): n=g or t
acagagaaatatgcctgcaacagcatattgaaactngagtacactctttttgttgatcttatgttgataaa

SEQ ID NO: 46998 - DNA, 71 bp, chicken (Gallus Gallus)
  misc_feature (36): n=a or g
tgatcttaatttctgcttgtcatgtttatttaaacnatgacctggaatatgggttagcagcagtacatttg

SEQ ID NO: 46999 - DNA, 71 bp, chicken (Gallus Gallus)
  misc_feature (36): n=a or g
aatgcaaatgcttctggaatgctagtgtaattctgncagatagtggaataatttgaaagtagtaggtgttc

SEQ ID NO: 47000 - DNA, 71 bp, chicken (Gallus Gallus)
  misc_feature (36): n=a or g
agtttcacaagctctgatttgagagtcaatttttgntcagtatgcctcactgaataaactggagcagggga

SEQ ID NO: 47001 - DNA, 71 bp, chicken (Gallus Gallus)
  misc_feature (36): n=c or t
caaaatgagggactagaaccaatgatctgttgtacnggtcagacagcaggcaaagtgtaagcatgtgttaa

SEQ ID NO: 47002 - DNA, 71 bp, chicken (Gallus Gallus)
  misc_feature (36): n=a or g
tggggtaagtaggtactgtagacatttttgttgctncaaatagagttccttctcttttcttggagactttg

SEQ ID NO: 47003 - DNA, 71 bp, chicken (Gallus Gallus)
  misc_feature (36): n=g or t
aagttagtaaaaattaaagtattgtatgaccaaganaaatgaattgaacttaagattgtcattactaggta

SEQ ID NO: 47004 - DNA, 71 bp, chicken (Gallus Gallus)
  misc_feature (36): n=c or t
aacgtttgcagggagctttgtaattctgggtcagcnctaagatgcgctacagaatatgacccccaggacac

SEQ ID NO: 47005 - DNA, 71 bp, chicken (Gallus Gallus)
  misc_feature (36): n=c or t
caaaccttaattcatcttttgactccacaagtagtnaatacatctgatagctagcatgcaggagacaacag

SEQ ID NO: 47006 - DNA, 71 bp, chicken (Gallus Gallus)
  misc_feature (36): n=c or t
cattctgggccaaagtctttgctcagttgtaaccangcaaacatctatggtgcatgtttgagagttaattt

SEQ ID NO: 47007 - DNA, 71 bp, chicken (Gallus Gallus)
  misc_feature (36): n=c or t
tttttatgccacttattttgtgattcatctatctgntgatcataatttatggtagtaaataaagataaaaa

SEQ ID NO: 47008 - DNA, 71 bp, chicken (Gallus Gallus)
  misc_feature (36): n=a or g
gcattggaatttcaagttcgctgcgagaagactatntgttagccaatgcttgaggaatattggcatgtact

SEQ ID NO: 47009 - DNA, 71 bp, chicken (Gallus Gallus)
  misc_feature (36): n=a or c
tttgattcatgctggtgtaaactgtggacgattctnacaacttcaaggagctcagataataatttccctgt

SEQ ID NO: 47010 - DNA, 71 bp, chicken (Gallus Gallus)
  misc_feature (36): n=a or g
agtcggataatgcatgtttcctggtttcaagttaantattcaaaatgctgggacatggcacaaaatgacat

SEQ ID NO: 47011 - DNA, 71 bp, chicken (Gallus Gallus)
  misc_feature (36): n=a or g
tccattttaaaagaaagcacacatggtcctggcatntgcctgacagactttcagtaacagccatttcccca

SEQ ID NO: 47012 - DNA, 71 bp, chicken (Gallus Gallus)
  misc_feature (36): n=c or t
acttgattgctgacaatgtgcttgctgctataaaancctaaaatgaagagcgctcttaacttgaggagttt

SEQ ID NO: 47013 - DNA, 71 bp, chicken (Gallus Gallus)
  misc_feature (36): n=c or t
ttaaaagattgtaagaaacaaagacacaatacttcnaaccaatttccaaaccttttctttgtccaagagaa

SEQ ID NO: 47014 - DNA, 71 bp, chicken (Gallus Gallus)
  misc_feature (36): n=a or g
ttattaaccgaataaaatgaatatggactgaattcnctaaattcgtatatcttgagcttctgagagccttg

SEQ ID NO: 47015 - DNA, 71 bp, chicken (Gallus Gallus)
  misc_feature (36): n=c or t
ggaaaaatgccaaaaaacaaaattcctgaatagctngttaaaattgaatccagcctcgttagttagtgcta

SEQ ID NO: 47016 - DNA, 71 bp, chicken (Gallus Gallus)
  misc_feature (36): n=a or g
acggtaattcaagagaagaaggatgtaaagggtaanataccagtgagaaattttaaagtgacaagtttcta

SEQ ID NO: 47017 - DNA, 71 bp, chicken (Gallus Gallus)
  misc_feature (36): n=c or t
cttgggctggagctttgagaaagctgatactccctntaaatttttacagatgcttctaatttaccagttca

SEQ ID NO: 47018 - DNA, 71 bp, chicken (Gallus Gallus)
  misc_feature (36): n=a or g
aactaagatactgaatacgaccaccactcagtcccncttcacatagctgagtccattcctgcatagtttaa

SEQ ID NO: 47019 - DNA, 71 bp, chicken (Gallus Gallus)
  misc_feature (36): n=g or t
gttcattctgagcagactgaaaataagggtagtccnactcaaaacagttattctgcccatgtagtttccgg

SEQ ID NO: 47020 - DNA, 71 bp, chicken (Gallus Gallus)
  misc_feature (36): n=a or g
tattgccctatgcatatgtataatctgtgtaaatgnaattttcagctgaatatactttaaaacagcattta

SEQ ID NO: 47021 - DNA, 71 bp, chicken (Gallus Gallus)
  misc_feature (36): n=a or g
ataggttagaatatttgattatctaattactgaatngcacttgtaactttatttttgatggcaagaattgt

SEQ ID NO: 47022 - DNA, 71 bp, chicken (Gallus Gallus)
  misc_feature (36): n=a or g
atttgtaatgtttctagtgcttctatgcacatcatntttatttagcagcagctcatggctattcctgtgtt

SEQ ID NO: 47023 - DNA, 71 bp, chicken (Gallus Gallus)
  misc_feature (36): n=a or g
tgacagagcatcctgccagacaaccaaatagctganctgaacaaagtgttcagagaagttctgcaataaac

SEQ ID NO: 47024 - DNA, 71 bp, chicken (Gallus Gallus)
  misc_feature (36): n=g or t
gcacgtaaggctgaattgattccagccattttcaancttttaccagttgaggtataaaaaagtactattca

SEQ ID NO: 47025 - DNA, 71 bp, chicken (Gallus Gallus)
  misc_feature (36): n=c or t
caattccaattagtgtttaatacagtcttgcagtangtggaagttcacgtggcccattatttcaaacagat

SEQ ID NO: 47026 - DNA, 71 bp, chicken (Gallus Gallus)
  misc_feature (36): n=c or t
tatgcagaaatttcagtaatatggtatcagtgccanaaccttcagtcagaatggttttaaaaatccatttc

SEQ ID NO: 47027 - DNA, 71 bp, chicken (Gallus Gallus)
  misc_feature (36): n=g or t
ctgatctgagattggtttatgccaactgcaagcctncaaaagcaatcttattgctgcagcaattagaattc

SEQ ID NO: 47028 - DNA, 71 bp, chicken (Gallus Gallus)
  misc_feature (36): n=a or g
agagtacctattaaataatagcacaaacagcatcancagctctttctctatttttctgagcctacaaagtg

SEQ ID NO: 47029 - DNA, 71 bp, chicken (Gallus Gallus)
  misc_feature (36): n=a or g
ctgtcatatggaatgctgaacatttcatgtttaacnttagactgcaaaatgcattgaatgagggaataatc

SEQ ID NO: 47030 - DNA, 71 bp, chicken (Gallus Gallus)
  misc_feature (36): n=a or g
ttctgaaaagaaggaaggcagatataatgaaagggncacaatccttccaaaaatgcagctgttttatttac

SEQ ID NO: 47031 - DNA, 71 bp, chicken (Gallus Gallus)
  misc_feature (36): n=c or t
attcatgcctaagaatactactaaaaataatccttnttatcattgtcagggcactgaaaccactggatcta

SEQ ID NO: 47032 - DNA, 71 bp, chicken (Gallus Gallus)
  misc_feature (36): n=c or t
ctacctctgtctacacattaagggagaatagctgangttgtccattgaaaccattcattctctatagtcca

SEQ ID NO: 47033 - DNA, 71 bp, chicken (Gallus Gallus)
  misc_feature (36): n=c or t
tagcagcaaaacctcaaagcctcaaatcattaaaanggaaggtgtaagctctcttctctttcttgagataa

SEQ ID NO: 47034 - DNA, 71 bp, chicken (Gallus Gallus)
  misc_feature (36): n=g or t
tttcagtttccaaccctcatgagttcagaccacagngtcagtcgaccttgccaggtgtaagcagaaaagaa

SEQ ID NO: 47035 - DNA, 71 bp, chicken (Gallus Gallus)
  misc_feature (36): n=a or g
gagagagtggcacatctatttctttggtggactgtnttattctagggatgctgaaccttttttgaatatta

SEQ ID NO: 47036 - DNA, 71 bp, chicken (Gallus Gallus)
  misc_feature (36): n=a or g
gaagaagtgtaggaaaagggattttaattgctatgnataatcatattcttacacactgagtaggtgtactt

SEQ ID NO: 47037 - DNA, 71 bp, chicken (Gallus Gallus)
  misc_feature (36): n=c or t
gagaagggctttctgtcttacagagctctctgaacnttggttgctggatctagtctgaatttccacagcca

SEQ ID NO: 47038 - DNA, 71 bp, chicken (Gallus Gallus)
  misc_feature (36): n=a or c
agggaggaaacattgttgtgcagaggacaaaagttnatctttcgtgctatagtagcatgctagttactgga

SEQ ID NO: 47039 - DNA, 71 bp, chicken (Gallus Gallus)
  misc_feature (36): n=g or t
atttcttctaatatcctactatagtgatcaatactngactctcaacacattctcatgccatgttttcttgt

SEQ ID NO: 47040 - DNA, 71 bp, chicken (Gallus Gallus)
  misc_feature (36): n=a or g
ttcaatgtgaatgcataaataagacctcttctaagntcaaagtgtcaggtggataacagcatctattctaa

SEQ ID NO: 47041 - DNA, 71 bp, chicken (Gallus Gallus)
  misc_feature (36): n=c or t
tccattctcataggctttcatttcatcacttaccanttataattttttttcacccaaatccttagtgcttc

SEQ ID NO: 47042 - DNA, 71 bp, chicken (Gallus Gallus)
  misc_feature (36): n=c or t
tttcccatcataagagactgtacagcaggcaagtangtggggggaaagaagatacaagctgaaagcagatg

SEQ ID NO: 47043 - DNA, 71 bp, chicken (Gallus Gallus)
  misc_feature (36): n=a or c
caatctgacatgaactctccatcagcatcttatacnttttctctttatgactttacaactttacaacgaac

SEQ ID NO: 47044 - DNA, 71 bp, chicken (Gallus Gallus)
  misc_feature (36): n=c or t
aattcctcttgcagtggtgataaaatcctgctcttnacaggtgatgctgaaaacagaaatgcaaaagctta

SEQ ID NO: 47045 - DNA, 71 bp, chicken (Gallus Gallus)
  misc_feature (36): n=c or t
gtctaattcttaatgctgtgtttacaaacagatgcnttctgtagccagatgcaaaattcatccaaaatgaa

SEQ ID NO: 47046 - DNA, 71 bp, chicken (Gallus Gallus)
  misc_feature (36): n=a or g
tatcttctcaacaaacagagactaccgagataaaangtgttccattttctgaggtacttatagccctagct

SEQ ID NO: 47047 - DNA, 71 bp, chicken (Gallus Gallus)
  misc_feature (36): n=c or t
gcagctcaaacaggtggtcaggttggtataaatganctcgcctggcagtcccactagttgttgaggaaaat

SEQ ID NO: 47048 - DNA, 71 bp, chicken (Gallus Gallus)
  misc_feature (36): n=a or c
ttttgaagaaatgaagcaagaagtgtgattctgttncacgttgtctttcagtatctgtcacaaatatgtct

SEQ ID NO: 47049 - DNA, 71 bp, chicken (Gallus Gallus)
  misc_feature (36): n=a or g
aagggggaagactctgtatgctgtgtggtgcaacanttctagaggggaaaggcactggaagaaaatctgaa

SEQ ID NO: 47050 - DNA, 71 bp, chicken (Gallus Gallus)
  misc_feature (36): n=g or t
ccaatggcagtgtaaataatgcagcaggatggtgcnacaaacagcagtgtttaggcagattggagaccgga

SEQ ID NO: 47051 - DNA, 71 bp, chicken (Gallus Gallus)
  misc_feature (36): n=a or g
agtaatgagtactgaatgttctttgaacaaaggttnctaatcctactcttagttctttgtatatataaata

SEQ ID NO: 47052 - DNA, 71 bp, chicken (Gallus Gallus)
  misc_feature (36): n=a or g
tgctgccaagaagggatgtttcaggttcagcacctncagagatctctcagcagggcccagactgtggtgag

SEQ ID NO: 47053 - DNA, 71 bp, chicken (Gallus Gallus)
  misc_feature (36): n=a or g
aactactattctctgaaatttgcaactcactgatancctctgtccagttacatcaatgaattaacccaaat

SEQ ID NO: 47054 - DNA, 71 bp, chicken (Gallus Gallus)
  misc_feature (36): n=c or t
cttgatcatccctactttttcattgcaaacaatgangggaaaataagatgcttaatcgctgcgaaagatgc

SEQ ID NO: 47055 - DNA, 71 bp, chicken (Gallus Gallus)
  misc_feature (36): n=a or g
cagcaaacgcattaatttctcttctcaatcattacncaagttactgctctgctctgtacaggtcatcagct

SEQ ID NO: 47056 - DNA, 71 bp, chicken (Gallus Gallus)
  misc_feature (36): n=a or g
taaaatattgtattgggattggaattatattccaanctcacattggtatttctgggacctaggaaggataa

SEQ ID NO: 47057 - DNA, 71 bp, chicken (Gallus Gallus)
  misc_feature (36): n=a or g
tgtttgtaactgcagcttcatgtcagcatttagtcnttgtggcacccactctatgttaaactcatgatctt

SEQ ID NO: 47058 - DNA, 71 bp, chicken (Gallus Gallus)
  misc_feature (36): n=g or t
aggtattttttttcagttaacaatctacagttgagntagtgagggagatagaagagaaactcatccatgat

SEQ ID NO: 47059 - DNA, 71 bp, chicken (Gallus Gallus)
  misc_feature (36): n=c or t
gcgtttcagttttttggtgcagaccacttgaaattntggaagtcttcaagggattgcattctcctacgtgg

SEQ ID NO: 47060 - DNA, 71 bp, chicken (Gallus Gallus)
  misc_feature (36): n=a or c
cctgttctgccaacatttcttgcttgcacagctgtnctaattacagtacactctttcttctctcactttcc

SEQ ID NO: 47061 - DNA, 71 bp, chicken (Gallus Gallus)
  misc_feature (36): n=c or t
aatttaggtcaggttgtcattgtgtatcggagtgtnggaactacagagataacagcagttcctaatctgga

SEQ ID NO: 47062 - DNA, 71 bp, chicken (Gallus Gallus)
  misc_feature (36): n=g or t
tagctgaacttctaggtggcttcttgatcatacctnttgtggctgagggccacaagttcataaagctgata

SEQ ID NO: 47063 - DNA, 71 bp, chicken (Gallus Gallus)
  misc_feature (36): n=c or t
tccctttctgaaaatcatgtttcagtcctttgcatntaattctaaaggaatcagtgccagaagactgtgtg

SEQ ID NO: 47064 - DNA, 71 bp, chicken (Gallus Gallus)
  misc_feature (36): n=c or t
ggagcttggggctgcttaagccctcctcctcctcantgtattcttaccccgtgacgaaaaatatcccaaat

SEQ ID NO: 47065 - DNA, 71 bp, chicken (Gallus Gallus)
  misc_feature (36): n=a or c
gcatgagcaaaaagtttcttaaactacaattacctntttcgattctcaatttaaacaaagttcctttgtaa

SEQ ID NO: 47066 - DNA, 71 bp, chicken (Gallus Gallus)
  misc_feature (36): n=a or g
gcctaaaatatctgccctagtagctctgcaagggtnctaaaaagataatgaatacccattttgttgacatg

SEQ ID NO: 47067 - DNA, 71 bp, chicken (Gallus Gallus)
  misc_feature (36): n=a or g
ctttgtatactgcccacctaggtcgtttggatgggnacttggattgttaagaatctttccaaggtgtagta

SEQ ID NO: 47068 - DNA, 71 bp, chicken (Gallus Gallus)
  misc_feature (36): n=c or t
ggaaattgcaagcaagttattttctccattgttagntgactttggctctgtgcattactaagttggcacaa

SEQ ID NO: 47069 - DNA, 71 bp, chicken (Gallus Gallus)
  misc_feature (36): n=a or g
ttttatcttagatgcatacaagaagttgatcagctnctgtacagaatataggtaatatgtaggcaagaatg

SEQ ID NO: 47070 - DNA, 71 bp, chicken (Gallus Gallus)
  misc_feature (36): n=c or t
agtggttcccctgcgtctttggtcttttcacttgtnctgctgtccttttccagtaatatacagcaagaact

SEQ ID NO: 47071 - DNA, 71 bp, chicken (Gallus Gallus)
  misc_feature (36): n=a or g
atccaccccatcagctgaataaaaaaacggaatccnttcttaactgtttaggtagacaggtgtgacaatat

SEQ ID NO: 47072 - DNA, 71 bp, chicken (Gallus Gallus)
  misc_feature (36): n=c or t
atttggaaagaaactctgatccctgggtgaagggtntgaaccttcatcacacaataaccctactctctagg

SEQ ID NO: 47073 - DNA, 71 bp, chicken (Gallus Gallus)
  misc_feature (36): n=a or g
tccaaaatgcctgtgaaaaatgttgatgatagtganctcctttacaacaaacaagatagttttacaaattc

SEQ ID NO: 47074 - DNA, 71 bp, chicken (Gallus Gallus)
  misc_feature (36): n=g or t
agattcccagacttctaaccacatggataatgcttntagaggatgattctggtattctcggtgctttgctg

SEQ ID NO: 47075 - DNA, 71 bp, chicken (Gallus Gallus)
  misc_feature (36): n=a or c
ataaataatgtatgggttggatgcactggattcatngttaacttgtgctctcagagcaggagaaattgctt

SEQ ID NO: 47076 - DNA, 71 bp, chicken (Gallus Gallus)
  misc_feature (36): n=c or t
atgtctcagcgcaactgcacacaagcctcagaaaantgaataacttattaaagacttaaaaaaacattctg

SEQ ID NO: 47077 - DNA, 71 bp, chicken (Gallus Gallus)
  misc_feature (36): n=a or g
tacaaagtgtcacagatatcagacccttactatgcntaaagtacatgctaaataagccaccatctaacagc

SEQ ID NO: 47078 - DNA, 71 bp, chicken (Gallus Gallus)
  misc_feature (36): n=a or g
taggagcacacaaggagaaatgcaaacccaaatgcntttggtatctggtggtttgaagtccatgcctcttc

SEQ ID NO: 47079 - DNA, 71 bp, chicken (Gallus Gallus)
  misc_feature (36): n=a or g
gattacaaagcattgcagaataactaacaaaaccanaattcacgcatttgcttaatgtaaacgtttcatta

SEQ ID NO: 47080 - DNA, 71 bp, chicken (Gallus Gallus)
  misc_feature (36): n=c or t
ctcgtgctttaccattgctgactttttggtttttcnttgagtaattgcctggtatttatcatgtcttacag

SEQ ID NO: 47081 - DNA, 71 bp, chicken (Gallus Gallus)
  misc_feature (36): n=c or t
ctctctgacttaagctgctaatgaggaaaggattcnaagtagcataaagagaccttcttaataacaagatg

SEQ ID NO: 47082 - DNA, 71 bp, chicken (Gallus Gallus)
  misc_feature (36): n=a or c
aacacacacagagtgcagcgcattttaaattgcacnatcagcttgaagcgttagttcactacctaacagtc

SEQ ID NO: 47083 - DNA, 71 bp, chicken (Gallus Gallus)
  misc_feature (36): n=a or g
taataatgttcctattaatacacttttctgtgtgtncttttgctttgaacatataacagtaatgaaaaaat

SEQ ID NO: 47084 - DNA, 71 bp, chicken (Gallus Gallus)
  misc_feature (36): n=c or t
ctgcatatcagattagaaagattagaatgatctttngtgccttttggaagtaatcagcaactggtgattct

SEQ ID NO: 47085 - DNA, 71 bp, chicken (Gallus Gallus)
  misc_feature (36): n=c or t
ctctaaacagttaagacacatatatgcaatacatanactaatgtacctgctgtagaccacttagttcctcc

SEQ ID NO: 47086 - DNA, 71 bp, chicken (Gallus Gallus)
  misc_feature (36): n=a or g
gcttgagattgaaggcatagaaagagagttgctacncaaaaattcttccaggtaaaaagatttggtgatgt

SEQ ID NO: 47087 - DNA, 71 bp, chicken (Gallus Gallus)
  misc_feature (36): n=a or g
aatatatttattatgtgtgacagccttcgtataatnatttattcttcatagtaggaattccacaagtgcca

SEQ ID NO: 47088 - DNA, 71 bp, chicken (Gallus Gallus)
  misc_feature (36): n=c or t
ggagggaagtgtgagtatgatcagatcaggatgggnagctactgcagagcatggagcagtctttgaacgtc

SEQ ID NO: 47089 - DNA, 71 bp, chicken (Gallus Gallus)
  misc_feature (36): n=a or g
tctggggtagaactatgacatttatagtaataattncactttcttcagcttggtatctgtcactgacatca

SEQ ID NO: 47090 - DNA, 71 bp, chicken (Gallus Gallus)
  misc_feature (36): n=a or g
gcactgatgtgattactttgtgccgatatgtttcantttgtgagctgcttacaaacaaatttgaactgact

SEQ ID NO: 47091 - DNA, 71 bp, chicken (Gallus Gallus)
  misc_feature (36): n=c or t
gtctcagtgtcaaagcttgaattccagacatgttgncctttaactgtgcaaatcactttacctttctttaa

SEQ ID NO: 47092 - DNA, 71 bp, chicken (Gallus Gallus)
  misc_feature (36): n=a or c
atatataagatgatagcaaacgtgcattaaaaaaanactttcactttttgcctaaatttaccatattgttc

SEQ ID NO: 47093 - DNA, 71 bp, chicken (Gallus Gallus)
  misc_feature (36): n=a or g
gttttaatgattaccaatatttctatcatgaactantgagttgatgaatggagtatgaaagcacagttagg

SEQ ID NO: 47094 - DNA, 71 bp, chicken (Gallus Gallus)
  misc_feature (36): n=c or t
catctttcttaaagaacagtatgtttatttatcaantcagaattactacaaggtaatgatgtatgatcagt

SEQ ID NO: 47095 - DNA, 71 bp, chicken (Gallus Gallus)
  misc_feature (36): n=g or t
gcgcagcagatattttcatataccctgaacataganaagctgaaaccagctagcctgtgttacgaagtttt

SEQ ID NO: 47096 - DNA, 71 bp, chicken (Gallus Gallus)
  misc_feature (36): n=g or t
ttgtgttttatttggatctcctgaatacacagttanattttgagtataaattaactccctcacagttcctc

SEQ ID NO: 47097 - DNA, 71 bp, chicken (Gallus Gallus)
  misc_feature (36): n=g or t
aaaaagggaatcaaatccaaatgttgcaactactcnaaatgcacacaagaaatgatttctctgtctatgtt

SEQ ID NO: 47098 - DNA, 71 bp, chicken (Gallus Gallus)
  misc_feature (36): n=c or t
gacttgtattttctcacggagaatttctgaatgaangaagtttatgtattaaattcctggaccaatgggaa

SEQ ID NO: 47099 - DNA, 71 bp, chicken (Gallus Gallus)
  misc_feature (36): n=c or t
aactgaattcaggaatgcttgatgcatttatgaccngcatgaaataatgaataaacctacaacgctttttc

SEQ ID NO: 47100 - DNA, 71 bp, chicken (Gallus Gallus)
  misc_feature (36): n=a or g
tgatgtatgggtggtgtgttgtagaagatttattcnggcaacaattagacaagttgaaagaacaaaattaa

SEQ ID NO: 47101 - DNA, 71 bp, chicken (Gallus Gallus)
  misc_feature (36): n=a or g
ctactagataaaatactatataaaatatcttcattnttagagccctaggagaggcaggtgcctgttgctgc

SEQ ID NO: 47102 - DNA, 71 bp, chicken (Gallus Gallus)
  misc_feature (36): n=a or g
aagaatgctttgctaatgaatccttgaacaaatgcnttgtgtgttactggagaggggggtagcgggaaaga

SEQ ID NO: 47103 - DNA, 71 bp, chicken (Gallus Gallus)
  misc_feature (36): n=a or c
ccaggtgtgggcagatgcacagtcttgggatagacngaagtgttcaagtaatcgggatgtccaaaagacgc

SEQ ID NO: 47104 - DNA, 71 bp, chicken (Gallus Gallus)
  misc_feature (36): n=a or c
aaaataaaaattgcattcagttacaatgaaggagcngtgaaaatctcagcagcagttgattgtctttgcag

SEQ ID NO: 47105 - DNA, 71 bp, chicken (Gallus Gallus)
  misc_feature (36): n=a or c
aggaggaagtaagagctgtagtggctaatgctttgntaatttttagactgttttttaattttaaaaattat

SEQ ID NO: 47106 - DNA, 71 bp, chicken (Gallus Gallus)
  misc_feature (36): n=a or g
gttttcctcctgagaggttttcattctggtacagcngatgtcaccaagatcatacacatgctgatggacac

SEQ ID NO: 47107 - DNA, 71 bp, chicken (Gallus Gallus)
  misc_feature (36): n=c or t
ttactcataattatacagcagaaagccttcaacaancaaaatataaacatcttctgtcatcttcagactgt

SEQ ID NO: 47108 - DNA, 71 bp, chicken (Gallus Gallus)
  misc_feature (36): n=a or g
agccttcttcccttctcaattttatggcatactgantgaatgagagtatacttgtatttggactgaaatga

SEQ ID NO: 47109 - DNA, 71 bp, chicken (Gallus Gallus)
  misc_feature (36): n=a or g
cagacatctgtatttaacttttactaagtaaggctntcagttaagcaattcactaccctactgatagtaat

SEQ ID NO: 47110 - DNA, 71 bp, chicken (Gallus Gallus)
  misc_feature (36): n=c or t
ttttcaagacattaaaatttgtataaaaatttctgnattcatctattctttcacaacacatttctttagca

SEQ ID NO: 47111 - DNA, 71 bp, chicken (Gallus Gallus)
  misc_feature (36): n=a or g
tgctacattctcatctttctcaacaagaggaagagntttatacaggtaattgctgtgttaactcagtagta

SEQ ID NO: 47112 - DNA, 71 bp, chicken (Gallus Gallus)
  misc_feature (36): n=c or t
acacatacagtctttgttagtggcttcctgtagtcnccatgctgctacatggttatctgtttgtacataag

SEQ ID NO: 47113 - DNA, 71 bp, chicken (Gallus Gallus)
  misc_feature (36): n=a or g
taaattctcaagtgaatattactgtagtataatttnatatacttgttctgtttcatcttttcctcatttac

SEQ ID NO: 47114 - DNA, 71 bp, chicken (Gallus Gallus)
  misc_feature (36): n=a or c
ccatggtgagtaactttaaagattacttctaatgtnggtcacaggaattctgaagaagtaaacacgacctt

SEQ ID NO: 47115 - DNA, 71 bp, chicken (Gallus Gallus)
  misc_feature (36): n=a or g
gaagagaaaacagtaatgcagcctttatacagtgantccctccattctaatccactgcaaattgtggtcta

SEQ ID NO: 47116 - DNA, 71 bp, chicken (Gallus Gallus)
  misc_feature (36): n=c or t
aatcctcttgtagtttttcatcaggctgaacaaagnctacgtgtctattatttctggtctttattacagag

SEQ ID NO: 47117 - DNA, 71 bp, chicken (Gallus Gallus)
  misc_feature (36): n=a or g
aactggtaatgagaactgttaaaaaagtagttaagncacaaaaaatagagatatgacaagcagtttgaaac

SEQ ID NO: 47118 - DNA, 71 bp, chicken (Gallus Gallus)
  misc_feature (36): n=a or g
ttcaaagccacccatttccctaattatagacactcntactgtaagaggaaattgctaattgtgtacagcag

SEQ ID NO: 47119 - DNA, 71 bp, chicken (Gallus Gallus)
  misc_feature (36): n=a or g
accttgcagccttctacagcaatgccacatggggcngccagtacaattcaggactgccacacaccctccgt

SEQ ID NO: 47120 - DNA, 71 bp, chicken (Gallus Gallus)
  misc_feature (36): n=a or g
ttaacacaaatacatacacactgcatatcagttagnccaagagtggtgttcctgccttttccagatactac

SEQ ID NO: 47121 - DNA, 71 bp, chicken (Gallus Gallus)
  misc_feature (36): n=g or t
attggtagaatattttgagggatattatttcatatnggtggttcaaggaagattgtgctaccactagccta

SEQ ID NO: 47122 - DNA, 71 bp, chicken (Gallus Gallus)
  misc_feature (36): n=g or t
ctctgttatacttctgttaatgagatcatcatctantctttctctagccaagatctaattatggtaaattc

SEQ ID NO: 47123 - DNA, 71 bp, chicken (Gallus Gallus)
  misc_feature (36): n=c or t
tgtgtattcctgttcaaagaaatactctcttccccntcaagaaggaaagggagataattgggctggctgac

SEQ ID NO: 47124 - DNA, 71 bp, chicken (Gallus Gallus)
  misc_feature (36): n=c or t
aggctcatttgtggtctccagcctgagcctggtaancataactctgaaccacgactgtagcagggatattg

SEQ ID NO: 47125 - DNA, 71 bp, chicken (Gallus Gallus)
  misc_feature (36): n=a or g
tacctgttctcctatttcactgcattgtgaatcacntaaatctgaagaacaatgggatcatatatatcatg

SEQ ID NO: 47126 - DNA, 71 bp, chicken (Gallus Gallus)
  misc_feature (36): n=g or t
tattctcctttagaatccaactgctaccatgttttncttcaaatctcataaagatcataaatctgagggga

SEQ ID NO: 47127 - DNA, 71 bp, chicken (Gallus Gallus)
  misc_feature (36): n=a or g
tgtcctattatggtataatgcagataataaataacnctgtgcatttgtcatcatgcaatcatgaagttcca

SEQ ID NO: 47128 - DNA, 71 bp, chicken (Gallus Gallus)
  misc_feature (36): n=g or t
ctacgtttctcacaatgtggtgtgtatggtgtgtantagtggaagggcatagacatggtttatcttaattt

SEQ ID NO: 47129 - DNA, 71 bp, chicken (Gallus Gallus)
  misc_feature (36): n=a or g
ggacactttcaacactctgcttctgttcactgacantgtgcgttacactatactatcactattgcactttt

SEQ ID NO: 47130 - DNA, 71 bp, chicken (Gallus Gallus)
  misc_feature (36): n=a or g
ttccatcttctcagggctgatctcctgcctctgctngaaaggctcaggggagccggcacaatctttagacc

SEQ ID NO: 47131 - DNA, 71 bp, chicken (Gallus Gallus)
  misc_feature (36): n=c or t
tcaggtattaccccacaagtattctccagcctgganaaaacttggtacttgtttactcctatagaaagctc

SEQ ID NO: 47132 - DNA, 71 bp, chicken (Gallus Gallus)
  misc_feature (36): n=c or t
tatgttttctgtggtctttcactttcttagctctcnattccaccattcttgttccctgtatctattgaagc

SEQ ID NO: 47133 - DNA, 71 bp, chicken (Gallus Gallus)
  misc_feature (36): n=c or t
ggcgcaagtagaagaaaagcctttaattttcccacngagttggactgctccctagtgtacagtaatttgca

SEQ ID NO: 47134 - DNA, 71 bp, chicken (Gallus Gallus)
  misc_feature (36): n=c or t
ctatactatccatagacgtgtggaaattttctttanagttaaatattaaaaatgtgacaagtgactgaaag

SEQ ID NO: 47135 - DNA, 71 bp, chicken (Gallus Gallus)
  misc_feature (36): n=c or t
aaagtcaagatggattactctgtaaatgtaaactangatgacacaagctactacgtggagtaatataggtt

SEQ ID NO: 47136 - DNA, 71 bp, chicken (Gallus Gallus)
  misc_feature (36): n=g or t
cagtcatgtgagtcatttaccagcaagtttaaaatnaatgaaactgaaaattataaggtgtcacgaagctt

SEQ ID NO: 47137 - DNA, 71 bp, chicken (Gallus Gallus)
  misc_feature (36): n=a or g
acacatatgggtgtacatgagattttgtcacattantgactgccatcaagtggctttgaggggcaaacgca

SEQ ID NO: 47138 - DNA, 71 bp, chicken (Gallus Gallus)
  misc_feature (36): n=c or t
cattgctcaagtcttcacttctcagcttgtgagtancccacatgcgtaagaagctgtaagtgttgttctca

SEQ ID NO: 47139 - DNA, 71 bp, chicken (Gallus Gallus)
  misc_feature (36): n=a or g
tgtcccctctttgtaatgaagatagctgggtggggngcaccaggaactggcatatctgaggatgtcaaatc

SEQ ID NO: 47140 - DNA, 71 bp, chicken (Gallus Gallus)
  misc_feature (36): n=g or t
agagctgcaagctgctcagtgtaactgcaaggaganagaggggagatatttttagctgcacaggagggaag

SEQ ID NO: 47141 - DNA, 71 bp, chicken (Gallus Gallus)
  misc_feature (36): n=a or c
ctctgaccctcatttatgggattgggagtatgaganaaggaaatgcaagacttcatctttgagcactcgtt

SEQ ID NO: 47142 - DNA, 71 bp, chicken (Gallus Gallus)
  misc_feature (36): n=a or g
ctgggatttattccactgtttgtaaatggactctgngaagtgacactgcataagagtgagaaaattgcagt

SEQ ID NO: 47143 - DNA, 71 bp, chicken (Gallus Gallus)
  misc_feature (36): n=a or c
aagaagttaatctcttaactccatcatgtaactaangctagacatgttcagaatatttcatgaatcttagt

SEQ ID NO: 47144 - DNA, 71 bp, chicken (Gallus Gallus)
  misc_feature (36): n=a or c
agaatttaaaattgcaccccttgacattaatacatnatgagaactgaaatgacataatttcttttacatat

SEQ ID NO: 47145 - DNA, 71 bp, chicken (Gallus Gallus)
  misc_feature (36): n=g or t
agtatagctgtggggctagctgggcactcaactgtncttggtggggttggctcccaataagcgctggctgt

SEQ ID NO: 47146 - DNA, 71 bp, chicken (Gallus Gallus)
  misc_feature (36): n=a or c
taaatgtctgtaattgttacagagtatctacagaantgcactctgctgtgcacacagattattgttactaa

SEQ ID NO: 47147 - DNA, 71 bp, chicken (Gallus Gallus)
  misc_feature (36): n=c or t
atcagttatgtgactgaaacaatattccttatcaanaaatctgaataggcacagacagattgatgtaagaa

SEQ ID NO: 47148 - DNA, 71 bp, chicken (Gallus Gallus)
  misc_feature (36): n=a or g
tcatatcaataacctatttgtcaattataaaagtgncatcatgatattgtataaatggaataaaacgtgca

SEQ ID NO: 47149 - DNA, 71 bp, chicken (Gallus Gallus)
  misc_feature (36): n=a or g
attaggactagaaaggcctaactggaggatctgggnaactcaggtcctctagaaatgagagtaattgttgt

SEQ ID NO: 47150 - DNA, 71 bp, chicken (Gallus Gallus)
  misc_feature (36): n=a or c
atagctaagctgtactacttgcaacacagatgctgngttaaacaaaatgagacatagtatcactcaaacca

SEQ ID NO: 47151 - DNA, 71 bp, chicken (Gallus Gallus)
  misc_feature (36): n=a or g
ctaaaactgactgaaatttttagtctcacataaganatgcaagtttagactgtacaccctagatacaaaaa

SEQ ID NO: 47152 - DNA, 71 bp, chicken (Gallus Gallus)
  misc_feature (36): n=c or t
attgagtagaaagtaagaccatggagaaaggtactncatattgatctctaggtgtggcagttattccttta

SEQ ID NO: 47153 - DNA, 71 bp, chicken (Gallus Gallus)
  misc_feature (36): n=a or g
tgtgtaacttctactaaccattacatttggtcaagnccttggtcagctctctgaaagagcaagactgagaa

SEQ ID NO: 47154 - DNA, 71 bp, chicken (Gallus Gallus)
  misc_feature (36): n=a or g
tatttcagcagagtaggaaaataactttgtcagatntatcttctgtagaggcatattaaggagataaattt

SEQ ID NO: 47155 - DNA, 71 bp, chicken (Gallus Gallus)
  misc_feature (36): n=a or c
agagaattttattgatactttgatatcatcaacctntttttatgaacttctattgcaagatacctttagtt

SEQ ID NO: 47156 - DNA, 71 bp, chicken (Gallus Gallus)
  misc_feature (36): n=g or t
gtgttttctttcctgccttaattagaagagcagttnccttttgtttttatgcagaatggaagacataattc

SEQ ID NO: 47157 - DNA, 71 bp, chicken (Gallus Gallus)
  misc_feature (36): n=a or g
agaacatatggtttccatgcatttcataaatacatntaacacacatttcattggaagctgagatttctgag

SEQ ID NO: 47158 - DNA, 71 bp, chicken (Gallus Gallus)
  misc_feature (36): n=a or g
gaagagtggaaacctcagaatgtagcaatattaggntcattttacatttcaccaaatcattagcatggatc

SEQ ID NO: 47159 - DNA, 71 bp, chicken (Gallus Gallus)
  misc_feature (36): n=a or g
tatccagcttctgctctcattccagcttcacatgangaacacttccttgaatcatcactggtatgatctac

SEQ ID NO: 47160 - DNA, 71 bp, chicken (Gallus Gallus)
  misc_feature (36): n=a or c
gaaaaaaaaatagtaatgaatggagttaccagatanaaggaatcctgaaaacactttagcattgtgatgac

SEQ ID NO: 47161 - DNA, 71 bp, chicken (Gallus Gallus)
  misc_feature (36): n=c or t
tagccaagggcagtaacccttcaagtacactggganttttaacacccaaaagactctatatcttggcacta

SEQ ID NO: 47162 - DNA, 71 bp, chicken (Gallus Gallus)
  misc_feature (36): n=c or t
acagctgggtgtactaaaaagttaggtcttgctctncagcaggcatacaccaaaatgaaagtcagtggatg

SEQ ID NO: 47163 - DNA, 71 bp, chicken (Gallus Gallus)
  misc_feature (36): n=c or t
ctgctgctgtaacatcagtgtaagaaagatgaccanggatctgatgctctagtgttttaagtatatgcata

SEQ ID NO: 47164 - DNA, 71 bp, chicken (Gallus Gallus)
  misc_feature (36): n=c or t
tacttggctactagtgatgatcaagtgaaattattncatgtaatacagtacatactgcatagaatgcactt

SEQ ID NO: 47165 - DNA, 71 bp, chicken (Gallus Gallus)
  misc_feature (36): n=a or g
ttccagccatgaggatgtgtttcctcctctgcatgntcaatgtgctgtgacttgcttgctaagtccttatc

SEQ ID NO: 47166 - DNA, 71 bp, chicken (Gallus Gallus)
  misc_feature (36): n=c or t
ttttatggagctagtcatgtagagtcctataagtanatccaccaatccagagttttttgaggaagcaattt

SEQ ID NO: 47167 - DNA, 71 bp, chicken (Gallus Gallus)
  misc_feature (36): n=a or g
ctgtttacaatgtaaccaccggattaagtgttctantgcttcagtgtaactgcagaaggcatgcaacttca

SEQ ID NO: 47168 - DNA, 71 bp, chicken (Gallus Gallus)
  misc_feature (36): n=c or t
tcctcccatcaaacaccctgctgtgcaactgggagngcttcatcctaacctcttctgccaataaactgtgc

SEQ ID NO: 47169 - DNA, 71 bp, chicken (Gallus Gallus)
  misc_feature (36): n=c or t
tgcttgtcattgattcatagttcatatacatactanagggtatcttatcaaatgagttgtacacatttcac

SEQ ID NO: 47170 - DNA, 71 bp, chicken (Gallus Gallus)
  misc_feature (36): n=c or t
aacaggtaccagatatttccaaatttatagtcaatngctgactacaaacttaatacttcttttttaaaaaa

SEQ ID NO: 47171 - DNA, 71 bp, chicken (Gallus Gallus)
  misc_feature (36): n=g or t
ccatcatatcctgctttataatttacacttcttctntggccctaaatgtcactgctgtcttcattctgtaa

SEQ ID NO: 47172 - DNA, 71 bp, chicken (Gallus Gallus)
  misc_feature (36): n=a or g
tcagtaaagtaatggctctgcaagtaagtgacatangattttgtgaaaattctacatagaaaatctaagaa

SEQ ID NO: 47173 - DNA, 71 bp, chicken (Gallus Gallus)
  misc_feature (36): n=c or t
catataagtaagatacagaatgaaataagagatggnagacagcaaaggtaggaaaaaaagatcttcttgat

SEQ ID NO: 47174 - DNA, 71 bp, chicken (Gallus Gallus)
  misc_feature (36): n=c or t
taaactgagataactagtttcagagaactgttctgntgtgttcaacagtgtctgcttgtgggtttggagag

SEQ ID NO: 47175 - DNA, 71 bp, chicken (Gallus Gallus)
  misc_feature (36): n=a or g
cgcttagtgacattatgctgcttgataatctaatcnccaatcaattacatcttctggtgcactaacaccag

SEQ ID NO: 47176 - DNA, 71 bp, chicken (Gallus Gallus)
  misc_feature (36): n=g or t
aactcctttgaaaagcaggttctgggatggaggggngcactgaaggacaatgcagagcagaagagataagg

SEQ ID NO: 47177 - DNA, 71 bp, chicken (Gallus Gallus)
  misc_feature (36): n=a or g
gttgctaaaaggttaactagatgcttgaagcttttncaagaagcctgcataattcgttatctcagtgactc

SEQ ID NO: 47178 - DNA, 71 bp, chicken (Gallus Gallus)
  misc_feature (36): n=c or t
acttgcaggtgtatgtagtatcacaagtagtatccncctaaaaatatcatatcaataatatgtcttcattt

SEQ ID NO: 47179 - DNA, 71 bp, chicken (Gallus Gallus)
  misc_feature (36): n=c or t
tttgtgccttgactgcaaaaccaaagcgccccctcnctcctggcagcacgcatagaggcggagttctgaca

SEQ ID NO: 47180 - DNA, 71 bp, chicken (Gallus Gallus)
  misc_feature (36): n=c or t
tacctcatacaaatgaaagctctgagaacagctaancaactgccatttctaagtgttatttgcattaagcg

SEQ ID NO: 47181 - DNA, 71 bp, chicken (Gallus Gallus)
  misc_feature (36): n=a or g
caaccagcatattcccagttgcagaagatcagaggnaaaagtactgtaaatgaagaagtaacagccaatac

SEQ ID NO: 47182 - DNA, 71 bp, chicken (Gallus Gallus)
  misc_feature (36): n=c or t
atgggtgatcccttccatcattacaaatctagaatngcttcagctttgacaggcaggaggaaagcaaagtc

SEQ ID NO: 47183 - DNA, 71 bp, chicken (Gallus Gallus)
  misc_feature (36): n=a or g
atttgtaatttggggagcactgatagctttagcagncttgcgaaatattgcaagggataaggtctgttttc

SEQ ID NO: 47184 - DNA, 71 bp, chicken (Gallus Gallus)
  misc_feature (36): n=a or g
tttattttctttctcctccccagataaaattgtctncctgcaaaatgaatcatctgaatttaggttttcct

SEQ ID NO: 47185 - DNA, 71 bp, chicken (Gallus Gallus)
  misc_feature (36): n=c or t
gatgtgctgcaagggtatgtaaactgcaggagtgtngaaaggtgtgtgcagcaatgtagtgtggttgcaag

SEQ ID NO: 47186 - DNA, 71 bp, chicken (Gallus Gallus)
  misc_feature (36): n=a or c
taacatgcaaccaattcaggagatcttgtgtgctgnaagatctgatttatgtgaaatgggagatgatacca

SEQ ID NO: 47187 - DNA, 71 bp, chicken (Gallus Gallus)
  misc_feature (36): n=c or t
acaaaatttacatcctcaataaaacaaggttaccanctacagagaacaattaaaaagggggcaaagtagaa

SEQ ID NO: 47188 - DNA, 71 bp, chicken (Gallus Gallus)
  misc_feature (36): n=a or g
atactctgaatttaagagatttttctcagtgatatngtttgtatgctaagctagaatagacctcattaaga

SEQ ID NO: 47189 - DNA, 71 bp, chicken (Gallus Gallus)
  misc_feature (36): n=a or g
gacaaaaaatgcaaaaaggggtaaaacaaaacatangagatcaatgcaaatcctgaagaattgagttaaat

SEQ ID NO: 47190 - DNA, 71 bp, chicken (Gallus Gallus)
  misc_feature (36): n=a or g
aattaaggacacagattttaccctgaagagcttatnatttgaatggatccataacatgatgaatgaacaca

SEQ ID NO: 47191 - DNA, 71 bp, chicken (Gallus Gallus)
  misc_feature (36): n=a or g
ccagcaagaaaggtggcacagagctgcctatcatgnaacagttgggtactcctgaccacgggacatctcaa

SEQ ID NO: 47192 - DNA, 71 bp, chicken (Gallus Gallus)
  misc_feature (36): n=a or g
tcacaacttataatgaatgtcttaactgtgcccctntttgtaagtgttacgttccttatatgataccttca

SEQ ID NO: 47193 - DNA, 71 bp, chicken (Gallus Gallus)
  misc_feature (36): n=a or g
gacaaaaagcaacatccagatgaagcatttcccctntgcagatgtttctcctagctgccttaatatagcag

SEQ ID NO: 47194 - DNA, 71 bp, chicken (Gallus Gallus)
  misc_feature (36): n=a or g
aactggctgaactccgctgtgtatggaattaaaganatagatgtgtgaagaagtaagcagaatgtaagttt

SEQ ID NO: 47195 - DNA, 71 bp, chicken (Gallus Gallus)
  misc_feature (36): n=g or t
tttgtgaagctctcagtttacctatgctaagactanacgtgtgcactaaaatttctactgtgtcgtcttcc

SEQ ID NO: 47196 - DNA, 71 bp, chicken (Gallus Gallus)
  misc_feature (36): n=a or g
atactaatatagccttccagaaatcacttaaagganttgtatatgatcttgcagagttacctgatatcaga

SEQ ID NO: 47197 - DNA, 71 bp, chicken (Gallus Gallus)
  misc_feature (36): n=a or g
agatttctatattcttaattgaaaccgtttgttggnaagttctttgtgtctgacttctcccatactgtcat

SEQ ID NO: 47198 - DNA, 71 bp, chicken (Gallus Gallus)
  misc_feature (36): n=c or t
aaaactcactgcttcacacaggggctgtgtttatancatggaaaccctcaggtcagcttcagttgatgcat

SEQ ID NO: 47199 - DNA, 71 bp, chicken (Gallus Gallus)
  misc_feature (36): n=a or c
tcaacaaatagatgatttgccgcatttcttaaactnagttctacatatgacaggcttatgtgcaactggcc

SEQ ID NO: 47200 - DNA, 71 bp, chicken (Gallus Gallus)
  misc_feature (36): n=c or t
cagagaaggtggactaggagaatgtggcatatggtnttctaaatgtcaagcacctgacgagtattgttcta

SEQ ID NO: 47201 - DNA, 71 bp, chicken (Gallus Gallus)
  misc_feature (36): n=g or t
tccaccatggtcagagtagtattcaatgaccacctngagatcaccagtaatatagacgtcaccagccttac

SEQ ID NO: 47202 - DNA, 71 bp, chicken (Gallus Gallus)
  misc_feature (36): n=c or t
tatacattttcagcaagatatgtgcatagtgttaanctacttttattgtttaaataacccagatagactag

SEQ ID NO: 47203 - DNA, 71 bp, chicken (Gallus Gallus)
  misc_feature (36): n=a or g
atttttctgaaacctcttgcaaattagatttaatancactacagtatggagaagaatccaagcttccatca

SEQ ID NO: 47204 - DNA, 71 bp, chicken (Gallus Gallus)
  misc_feature (36): n=a or g
cagaaatcagagccagcataccccactcctcgtttntgctgtggaggaagaagcgcctgtgagtctaccga

SEQ ID NO: 47205 - DNA, 71 bp, chicken (Gallus Gallus)
  misc_feature (36): n=a or c
gatgttccattctttctcaacatttatcagcacttnaattgtcatctaattcccaattactttgttcttat

SEQ ID NO: 47206 - DNA, 71 bp, chicken (Gallus Gallus)
  misc_feature (36): n=a or g
caaatgtgatcatgatgatactatagtatagcagtngtatggatgttgagtttttcttggatcatttaaat

SEQ ID NO: 47207 - DNA, 71 bp, chicken (Gallus Gallus)
  misc_feature (36): n=a or g
gaagtgaatagaataaacaaaaatggccttatattntgtttcaggaagtttgcagtaaggttacccaaggt

SEQ ID NO: 47208 - DNA, 71 bp, chicken (Gallus Gallus)
  misc_feature (36): n=a or c
ctaggaagacctacctctttcctgtgtcttctcatnttaggacccataacacatgctgaggcctgtttgaa

SEQ ID NO: 47209 - DNA, 71 bp, chicken (Gallus Gallus)
  misc_feature (36): n=c or t
tcaactgtatcctttcttaggaaagcataacgagtntgggggctttgcagtctgtcttcatttctgcttac

SEQ ID NO: 47210 - DNA, 71 bp, chicken (Gallus Gallus)
  misc_feature (36): n=c or t
ttcaataggccatgagctgcattacttcagcacaantgatgaagaaaagatagatcagtgaccttagcatt

SEQ ID NO: 47211 - DNA, 71 bp, chicken (Gallus Gallus)
  misc_feature (36): n=c or t
agcatccagatacctgctcaggaggaataaacaatncctttagttactaggtatgttccttcttatttctc

SEQ ID NO: 47212 - DNA, 71 bp, chicken (Gallus Gallus)
  misc_feature (36): n=c or t
cctgagtgtgccattaggtttctctaatgagtaacngcatcttatctgcaacctgaagcaataatttatgg

SEQ ID NO: 47213 - DNA, 71 bp, chicken (Gallus Gallus)
  misc_feature (36): n=a or g
cactgtcagcttccccaaacactgtccctccaagtnctaagggccaatgaaaggattctcacaaacagttg

SEQ ID NO: 47214 - DNA, 71 bp, chicken (Gallus Gallus)
  misc_feature (36): n=a or g
tgatgcaattatttgctagaaaggaagtaggagttngtgtgttctgcatggtgtatttctggcttgtgcca

SEQ ID NO: 47215 - DNA, 71 bp, chicken (Gallus Gallus)
  misc_feature (36): n=a or g
tctgggttatattctggtttaagatttcttcacagnactcttgctgacatcagtaagaggtacgctttcat

SEQ ID NO: 47216 - DNA, 71 bp, chicken (Gallus Gallus)
  misc_feature (36): n=a or c
ttaccttctcccatctcatcttttcttataacaaanaagcataaattagttagtgatgtgtatgctgacag

SEQ ID NO: 47217 - DNA, 71 bp, chicken (Gallus Gallus)
  misc_feature (36): n=c or t
aggatatgttctgcatagattgtcttttatagtgancatttacttagtgttaatttcttatgctaccctaa

SEQ ID NO: 47218 - DNA, 71 bp, chicken (Gallus Gallus)
  misc_feature (36): n=c or t
tattacattagtatgactataggagtaggtacatangtgcctagtgacttgaacttttcatagttctttac

SEQ ID NO: 47219 - DNA, 71 bp, chicken (Gallus Gallus)
  misc_feature (36): n=c or t
ctattgatttaatgctctttcataaatattcttcantgttaagtttgatatataagtatggaacagtttgg

SEQ ID NO: 47220 - DNA, 71 bp, chicken (Gallus Gallus)
  misc_feature (36): n=a or g
aatctcgttaaatcacattcaattacttcttgatgngtaaagctccttttctccgtacccattttggatcc

SEQ ID NO: 47221 - DNA, 71 bp, chicken (Gallus Gallus)
  misc_feature (36): n=c or t
aagtaatgcttctttagcctatagccagaaactcanagctggcagtcaagacaatcctcaaggtgcctaat

SEQ ID NO: 47222 - DNA, 71 bp, chicken (Gallus Gallus)
  misc_feature (36): n=c or t
aaggaagccttcttgtgtcactgcacattagcattnttttctttccgtgtctcctgacagctattaagagg

SEQ ID NO: 47223 - DNA, 71 bp, chicken (Gallus Gallus)
  misc_feature (36): n=c or t
tgactttcaagtttctctgaaaacagcatatgtgancatacggctaagtcactcttattgttttgtcattc

SEQ ID NO: 47224 - DNA, 71 bp, chicken (Gallus Gallus)
  misc_feature (36): n=c or t
aggcagaacttaagaacaactttcttctctgcctgnacttggttttgctgggttaaacaaactgacaatac

SEQ ID NO: 47225 - DNA, 71 bp, chicken (Gallus Gallus)
  misc_feature (36): n=a or g
taaaggctaatgcacttttcttcaagagatgcaccntaaaatgtttcttaaagattatcctgtctcagagt

SEQ ID NO: 47226 - DNA, 71 bp, chicken (Gallus Gallus)
  misc_feature (36): n=a or g
tcacttagtcaaattattgcagtaatttttagtctnaaagtattgttagatatcatgctattcatatcaca

SEQ ID NO: 47227 - DNA, 71 bp, chicken (Gallus Gallus)
  misc_feature (36): n=a or g
ctaggcacaggaacctcatacaatacagctgtgccnccaacagtgggctttgtgcatatgctgtctgcata

SEQ ID NO: 47228 - DNA, 71 bp, chicken (Gallus Gallus)
  misc_feature (36): n=a or g
aaacagaaaaatctggagacagttctggtctttagntagaaaaaatgccaacatgccaaaggatggttaca

SEQ ID NO: 47229 - DNA, 71 bp, chicken (Gallus Gallus)
  misc_feature (36): n=a or c
gtacttagctgcacttacctgtacttacctgactgnaccagtgaagtacatttcaaagcgcaccaggatca

SEQ ID NO: 47230 - DNA, 71 bp, chicken (Gallus Gallus)
  misc_feature (36): n=c or t
tcattgtgctgatggcataactgatgtgcagcagangagggagttggaggatctgggagtcagtgatggct

SEQ ID NO: 47231 - DNA, 71 bp, chicken (Gallus Gallus)
  misc_feature (36): n=a or g
caagacagcaagggtgcattaccttcctgtgttcanaagtgccaaagctaattgatatttcctttgccaaa

SEQ ID NO: 47232 - DNA, 71 bp, chicken (Gallus Gallus)
  misc_feature (36): n=c or t
tgccaggttaacaataaaggcaagtcagctctacanagtaaacaacaacatgagggaaagcgatccctggc

SEQ ID NO: 47233 - DNA, 71 bp, chicken (Gallus Gallus)
  misc_feature (36): n=c or t
gggaagtataatgctaagcaatttgaatgagaaganatgctgtgtaactcctcactacagaatgtgtccct

SEQ ID NO: 47234 - DNA, 71 bp, chicken (Gallus Gallus)
  misc_feature (36): n=a or g
cttccctccaccaataccactggatgaacagaaaancacagttgattaaggtattgcttattctggcaaag

SEQ ID NO: 47235 - DNA, 71 bp, chicken (Gallus Gallus)
  misc_feature (36): n=c or t
atttttccctgttttgcactttgtgctgtcacttanacaattattaagggggcagaaaatgtcagtcttac

SEQ ID NO: 47236 - DNA, 71 bp, chicken (Gallus Gallus)
  misc_feature (36): n=a or g
ggcctggcatgtcccacagaagcagtacttacccangtgaaataattcactttgactgaggcacgttttag

SEQ ID NO: 47237 - DNA, 71 bp, chicken (Gallus Gallus)
  misc_feature (36): n=c or t
ttaaaaacctttccgagctatgcatttctggcgggnactcgggagcacgggaaattcgaaaagacctgtga

SEQ ID NO: 47238 - DNA, 71 bp, chicken (Gallus Gallus)
  misc_feature (36): n=c or t
agctgccacttcaacatctctcagcaattcagctcncccaatagcattaccaaaaacactgagctttgaat

SEQ ID NO: 47239 - DNA, 71 bp, chicken (Gallus Gallus)
  misc_feature (36): n=a or g
tcagaaacatttgagctcaaacaccaagagaatatnttagcttaatagatgagtcttttcctccagacacg

SEQ ID NO: 47240 - DNA, 71 bp, chicken (Gallus Gallus)
  misc_feature (36): n=g or t
cctctgtatacttctatcatctcccttcatgaaaanggggaacagattcatgaaagattaatataacaaag

SEQ ID NO: 47241 - DNA, 71 bp, chicken (Gallus Gallus)
  misc_feature (36): n=c or t
gcaagtaatacaaaatacaaacgttaaaagttgtgncgtcgtctttttcagatttacctatatattttacg

SEQ ID NO: 47242 - DNA, 71 bp, chicken (Gallus Gallus)
  misc_feature (36): n=g or t
cagctggcacaactgggccatgaatgcctgaccttnttgtatgtattgatttttgtatgatatacacatgt

SEQ ID NO: 47243 - DNA, 71 bp, chicken (Gallus Gallus)
  misc_feature (36): n=c or t
ctttctgataatacttaacagtgtaccatagaagcngtattatgtacattttatcaaaaatactctccact

SEQ ID NO: 47244 - DNA, 71 bp, chicken (Gallus Gallus)
  misc_feature (36): n=a or g
agcaaaaaatcaattgaaatagctgtaacttaagantgagaaagagtctgccactatacatgaagcaaaga

SEQ ID NO: 47245 - DNA, 71 bp, chicken (Gallus Gallus)
  misc_feature (36): n=c or t
cctactgaagaaagatcaaagcccattccctcattnctccaggttttttagcaaagttttctgtcagaatg

SEQ ID NO: 47246 - DNA, 71 bp, chicken (Gallus Gallus)
  misc_feature (36): n=a or g
ttctgactgcctaggtggatcgctccttcccggacnttcccagtggggtgctggttgtcaatcatcccaat

SEQ ID NO: 47247 - DNA, 71 bp, chicken (Gallus Gallus)
  misc_feature (36): n=g or t
aattcagacaacatctgtgcatcaggacagcacagnttatatgaaactctatgcatagcattcagaaagga

SEQ ID NO: 47248 - DNA, 71 bp, chicken (Gallus Gallus)
  misc_feature (36): n=a or g
atctatctaaaaatattgaattatctaagatacatnaatcattctctctagttcctctctgaatatgcaac

SEQ ID NO: 47249 - DNA, 71 bp, chicken (Gallus Gallus)
  misc_feature (36): n=c or t
ttgtgtatgtgaggacacaaaaatgtcagtaacttngtttaagctttgttttgcaagggtaaaatacatta

SEQ ID NO: 47250 - DNA, 71 bp, chicken (Gallus Gallus)
  misc_feature (36): n=a or g
taagacttaattttatcatttccataggccatctgngctttttccctgttagtgattttgtcttccttatt

SEQ ID NO: 47251 - DNA, 71 bp, chicken (Gallus Gallus)
  misc_feature (36): n=c or t
acaagcttctaatgtatatatactgttggggaaacntcttatggaaagctgtaactcaaaagagttaaata

SEQ ID NO: 47252 - DNA, 71 bp, chicken (Gallus Gallus)
  misc_feature (36): n=a or g
actgctgagtggctgttgatggagtactgcactganatgggggtccctgatgtctccctcttcatcaggga

SEQ ID NO: 47253 - DNA, 71 bp, chicken (Gallus Gallus)
  misc_feature (36): n=c or t
ctccacttgcaaattaaaagagcatttggctactcngcttgctcagctagagatttggtagcctggaaatc

SEQ ID NO: 47254 - DNA, 71 bp, chicken (Gallus Gallus)
  misc_feature (36): n=a or g
gtaaattaaggttcaaagtatgcctacaaatttctntgcaaatatgcaggttttaaggcagaaactgatcc

SEQ ID NO: 47255 - DNA, 71 bp, chicken (Gallus Gallus)
  misc_feature (36): n=a or c
attctttcaaagagaagtggaacttctaatagttcntcttagtctgaaatgagttctctaataaagtttac

SEQ ID NO: 47256 - DNA, 71 bp, chicken (Gallus Gallus)
  misc_feature (36): n=c or t
gtatctaagaaatgccagagaagttttggaactaantgtttttctctctttatgtgccaccatgattcaaa

SEQ ID NO: 47257 - DNA, 71 bp, chicken (Gallus Gallus)
  misc_feature (36): n=a or g
accacatccaatcatcgcacgacagagaggtaaaanatgtttccaccagaggtgacagagcaggctgtgaa

SEQ ID NO: 47258 - DNA, 71 bp, chicken (Gallus Gallus)
  misc_feature (36): n=a or c
gctttctcatatcctatgtgaatgccctaataaaanctagtatttgctgtccctagtgcataatctttttt

SEQ ID NO: 47259 - DNA, 71 bp, chicken (Gallus Gallus)
  misc_feature (36): n=a or g
gtcagaaagatagtagaaaatggttgctttgagccntaggcaatggcttgaattttgtcatcaagtaatga

SEQ ID NO: 47260 - DNA, 71 bp, chicken (Gallus Gallus)
  misc_feature (36): n=a or g
tacaggaccacaggctctcatgctcttatgctggangtagcaataaactcaggcagcttgcccctccatgt

SEQ ID NO: 47261 - DNA, 71 bp, chicken (Gallus Gallus)
  misc_feature (36): n=a or g
acagtgctgtttttaacagtgagaccttttcctgcntgcttcaccatagctgtcacctttaataaccctgc

SEQ ID NO: 47262 - DNA, 71 bp, chicken (Gallus Gallus)
  misc_feature (36): n=a or g
tggattagagaattttactggaattagacagtgtcncttgtcatgtctttgcatacaaatactgtgtgaag

SEQ ID NO: 47263 - DNA, 71 bp, chicken (Gallus Gallus)
  misc_feature (36): n=g or t
gatgttgtcccccaacaaaggaaccttgttcaaagntagttaccacttttctaaatataaagacccatctt

SEQ ID NO: 47264 - DNA, 71 bp, chicken (Gallus Gallus)
  misc_feature (36): n=a or g
cacaatgatgcaatgcaatgtgaaaaattctatgantcagtttgcgtactgaaaccaagtactaatgcatg

SEQ ID NO: 47265 - DNA, 71 bp, chicken (Gallus Gallus)
  misc_feature (36): n=c or t
catccagctactgtttgagctaagcctagaactagncttcctgaagcctctgtagtttgtgtcaaaagaaa

SEQ ID NO: 47266 - DNA, 71 bp, chicken (Gallus Gallus)
  misc_feature (36): n=a or g
gtttaaaaactctacagaaattactcaactttttcnttaaagaactcccaggaataaaaatatattatact

SEQ ID NO: 47267 - DNA, 71 bp, chicken (Gallus Gallus)
  misc_feature (36): n=a or g
ggattcacaaggaaaaagatgctttctagccccctntatcagcatcacagtcagccttgctaatgtagctg

SEQ ID NO: 47268 - DNA, 71 bp, chicken (Gallus Gallus)
  misc_feature (36): n=a or c
tagtgttcctttgaagaagaaataaataaatgtttnttggatcttaccaacccagataccttaatgaaact

SEQ ID NO: 47269 - DNA, 71 bp, chicken (Gallus Gallus)
  misc_feature (36): n=a or g
caaatttaaggtaatgattctgtcttatgtataaancgctttggaattaatggggaagaagcattgcttaa

SEQ ID NO: 47270 - DNA, 71 bp, chicken (Gallus Gallus)
  misc_feature (36): n=a or g
cagcttctatagcgttggatttgagagaggcagagngggtcagaaaggagaaaactaatgagttcagaaaa

SEQ ID NO: 47271 - DNA, 71 bp, chicken (Gallus Gallus)
  misc_feature (36): n=a or c
aaacatcaaatgtcttgagtacaagtaaagcagttnatgtagtaaaagcacaacaactgttttaatgaaaa

SEQ ID NO: 47272 - DNA, 71 bp, chicken (Gallus Gallus)
  misc_feature (36): n=a or g
cagaactctgcagatccccaatgcacttcagtgtcncattaattatgttagtcactctaacaaatctggtg

SEQ ID NO: 47273 - DNA, 71 bp, chicken (Gallus Gallus)
  misc_feature (36): n=a or c
gacatggagctgattgcccagaggaattggggtacntatattcgtgctattgtacatgtgagtagcttgaa

SEQ ID NO: 47274 - DNA, 71 bp, chicken (Gallus Gallus)
  misc_feature (36): n=a or g
gattcttctgccacctaatcacacacaaatgagacngaattcatggacctttacagttttaagaatcaaag

SEQ ID NO: 47275 - DNA, 71 bp, chicken (Gallus Gallus)
  misc_feature (36): n=a or g
ttcactttctgtgagaagtcctgtgaactggatganttacagtaattccatcttggagagctgacagcttg

SEQ ID NO: 47276 - DNA, 71 bp, chicken (Gallus Gallus)
  misc_feature (36): n=a or g
tgtagaactcatactactgaagcaaaaaattatgcntatagaaatcatgaaaagttaagtatttcttgaaa

SEQ ID NO: 47277 - DNA, 71 bp, chicken (Gallus Gallus)
  misc_feature (36): n=g or t
gtaagcctgagctacttacagaccttgagtgatatnctttctgggggtcaggtgacttcctgccaagtacc

SEQ ID NO: 47278 - DNA, 71 bp, chicken (Gallus Gallus)
  misc_feature (36): n=a or g
ttactcccataaagcatttcaaacatctgtgcccantgttgaatgctctgtgctgtcatctgttgaacagc

SEQ ID NO: 47279 - DNA, 71 bp, chicken (Gallus Gallus)
  misc_feature (36): n=a or g
ctcccacagagaagcccgtgttctctgcaagccgtnaagaaatgatgaggacttgctttcgctaagaccta

SEQ ID NO: 47280 - DNA, 71 bp, chicken (Gallus Gallus)
  misc_feature (36): n=a or g
gttttagaaaaaagcaaactagttcccaggctaaancagggcctcaacaatagggaaagtaaaccttttca

SEQ ID NO: 47281 - DNA, 71 bp, chicken (Gallus Gallus)
  misc_feature (36): n=a or g
cgatcatgagactcttgggctgttgttgagatccantctgttttcctttaccaatctctcagtaaaaacat

SEQ ID NO: 47282 - DNA, 71 bp, chicken (Gallus Gallus)
  misc_feature (36): n=a or g
gcatagattttatgattcacagtagttgtgcaaaantaaaacttaaaacctctgcaggcagacttgccata

SEQ ID NO: 47283 - DNA, 71 bp, chicken (Gallus Gallus)
  misc_feature (36): n=c or t
accaaacagtacttaaactccatttgctgtgtactngtgaataaaagaattggaagttccgtgttataatg

SEQ ID NO: 47284 - DNA, 71 bp, chicken (Gallus Gallus)
  misc_feature (36): n=a or g
ctataagacaaaggtaagtttggatgactgttaaanctgcttaaatagctgaatgttcaagctacagctgt

SEQ ID NO: 47285 - DNA, 71 bp, chicken (Gallus Gallus)
  misc_feature (36): n=c or t
taaaagtgtccttgctgtaagacaacatatacaaantctgaatttgaagacacagcttccacagttagcca

SEQ ID NO: 47286 - DNA, 71 bp, chicken (Gallus Gallus)
  misc_feature (36): n=c or t
tacttaggaaaaaatctagatatcagacttagtcantgcatacacaagtctgtggctttttcagtttgttc

SEQ ID NO: 47287 - DNA, 71 bp, chicken (Gallus Gallus)
  misc_feature (36): n=g or t
gatatttttttacggagttgagggcgcatgtgaccnatcaggggtctccatagcaggtctggctcctgtgg

SEQ ID NO: 47288 - DNA, 71 bp, chicken (Gallus Gallus)
  misc_feature (36): n=a or g
cccctaactgcccttccatcctgaagcaaaattcanctagttttgtgggaagttactaaataaaacaacat

SEQ ID NO: 47289 - DNA, 71 bp, chicken (Gallus Gallus)
  misc_feature (36): n=a or c
caacagtcagaccaaaatcaggtatttcttcatttnttttcctttgcaaagcaccacaagtaacataacat

SEQ ID NO: 47290 - DNA, 71 bp, chicken (Gallus Gallus)
  misc_feature (36): n=a or g
tttgctgcagcagctaaagcaaaagagcagctaggnacacacctgatacagttctgcctgcctgaagcctt

SEQ ID NO: 47291 - DNA, 71 bp, chicken (Gallus Gallus)
  misc_feature (36): n=a or g
atctgcggtcagaggcatggccgctggtgcattgcngtgtacaggaactcagtgggctggttcggatgtga

SEQ ID NO: 47292 - DNA, 71 bp, chicken (Gallus Gallus)
  misc_feature (36): n=c or t
tcccattagctcagctttcccattggctgctcttcntctatagtaggagttacaatttcatgcctgacatc

SEQ ID NO: 47293 - DNA, 71 bp, chicken (Gallus Gallus)
  misc_feature (36): n=a or c
ggttttaatacattctgatgctgaagactacaatanaggagccagaaattagctgtggtgtaggaccttca

SEQ ID NO: 47294 - DNA, 71 bp, chicken (Gallus Gallus)
  misc_feature (36): n=a or g
gataactgcagtgccaatggatttacaaacaatgancaggtcaatggcagagatgtgcagggagcacatat

SEQ ID NO: 47295 - DNA, 71 bp, chicken (Gallus Gallus)
  misc_feature (36): n=a or g
tctcttctgtccataacaggaatggtgaggcaaacnttctctatgaactgctttgagacacaataatgaga

SEQ ID NO: 47296 - DNA, 71 bp, chicken (Gallus Gallus)
  misc_feature (36): n=c or t
tgtagatattatgtttgaaggtcttcatttgggganaagttttcttgctgaaaacttctgttcagttgaat

SEQ ID NO: 47297 - DNA, 71 bp, chicken (Gallus Gallus)
  misc_feature (36): n=a or g
gtgagatgttcacaagtatacttctagtctctttcnctactactgtttgcgtcactaccctagtgttctat

SEQ ID NO: 47298 - DNA, 71 bp, chicken (Gallus Gallus)
  misc_feature (36): n=a or c
atataagactcactccaactcagaaaagccaaaaanatacatgtaacagaagagccttaattacactgcaa

SEQ ID NO: 47299 - DNA, 71 bp, chicken (Gallus Gallus)
  misc_feature (36): n=a or g
atgcatagacagactgataggtcacaatattcatcncaaccaagtttttatagagcaaaccttcacctagt

SEQ ID NO: 47300 - DNA, 71 bp, chicken (Gallus Gallus)
  misc_feature (36): n=a or g
cgtgactccaactgcaagcaaagtatgctactcctntttcccacaagtacttcatatggaccaaattcaga

SEQ ID NO: 47301 - DNA, 71 bp, chicken (Gallus Gallus)
  misc_feature (36): n=a or g
tcagtgagtagacaatgactctgagccaccccagtncagtaacagaagcagcttgaaaatctctgaaacta

SEQ ID NO: 47302 - DNA, 71 bp, chicken (Gallus Gallus)
  misc_feature (36): n=c or t
caaaaagtgctagaaatttggtaaaccatctacttngtccgctgttctgtcttccagtaaattcctatctt

SEQ ID NO: 47303 - DNA, 71 bp, chicken (Gallus Gallus)
  misc_feature (36): n=c or t
atcatatccacaacctccttcttttcaactctgcanatgtatagagtcattccaatttctccagaagttgt

SEQ ID NO: 47304 - DNA, 71 bp, chicken (Gallus Gallus)
  misc_feature (36): n=c or t
cgaacatacagcctgcactaatgcttcagggtaaanggatccaaaattatcttatttacaagctctttggc

SEQ ID NO: 47305 - DNA, 71 bp, chicken (Gallus Gallus)
  misc_feature (36): n=g or t
tctgagcatcagtaaacagaactgaaagtcactttncagctctcatttcagtatagctgtgtgaaatgaga

SEQ ID NO: 47306 - DNA, 71 bp, chicken (Gallus Gallus)
  misc_feature (36): n=c or t
gaaagaataagttccatttagactacacttctacangtgataaactacacttgtcatgagtttttctggga

SEQ ID NO: 47307 - DNA, 71 bp, chicken (Gallus Gallus)
  misc_feature (36): n=a or g
agcaataccttcagcaagtatctcagatcagcccanaagtaggggaagagaagtttctggatgagatgcaa

SEQ ID NO: 47308 - DNA, 71 bp, chicken (Gallus Gallus)
  misc_feature (36): n=c or t
gttgcttttcacccagtttggcattctagctcaagnttaggccaatattaaatgtagacacaaaacttctt

SEQ ID NO: 47309 - DNA, 71 bp, chicken (Gallus Gallus)
  misc_feature (36): n=c or t
tggccaaaatcctctaagcagaaactacctgccaanattttagtttttaatttcaatttcttaatttgtag

SEQ ID NO: 47310 - DNA, 71 bp, chicken (Gallus Gallus)
  misc_feature (36): n=a or g
gaaggatgcagacattttgaagtgctaagtgggatntgtggcacgtgtaatgcctttgaaatataaatttt

SEQ ID NO: 47311 - DNA, 71 bp, chicken (Gallus Gallus)
  misc_feature (36): n=a or g
catgtatcaatactaagcttttcttatcctatagcncactaagttcgatctatttctttgcatgtattttt

SEQ ID NO: 47312 - DNA, 71 bp, chicken (Gallus Gallus)
  misc_feature (36): n=a or g
atttcctgaactggtggctgaatcctattcattgtntttaatagctacccttgaatgtatctgctgtgaat

SEQ ID NO: 47313 - DNA, 71 bp, chicken (Gallus Gallus)
  misc_feature (36): n=c or t
gcagggaaagattagacactgcagtaagtgtatgtnttatatgtgataatatgtgtatgtggtaggctctt

SEQ ID NO: 47314 - DNA, 71 bp, chicken (Gallus Gallus)
  misc_feature (36): n=c or t
ctctctatgtgtcacacacttttgaacctgctgtangtctatgtgctctatacgtctattctatgtgctgt

SEQ ID NO: 47315 - DNA, 71 bp, chicken (Gallus Gallus)
  misc_feature (36): n=a or g
tacatttgcttgtatcttctgaacacttcttcctantttttatttacgttctttatctttccccctctcag

SEQ ID NO: 47316 - DNA, 71 bp, chicken (Gallus Gallus)
  misc_feature (36): n=a or c
tagcctgcagcatgtatgattttacactctttcagncttacgggaggcagctgcacgtgctgcagtgtaat

SEQ ID NO: 47317 - DNA, 71 bp, chicken (Gallus Gallus)
  misc_feature (36): n=c or t
ctgaagcacgatgtatcaaccttatgctcttagggncttttgcattcagaactttgactgtggtgagtctg

SEQ ID NO: 47318 - DNA, 71 bp, chicken (Gallus Gallus)
  misc_feature (36): n=c or t
agcactgcaatgggtaagtaactgtataaacagtanatcaaacttgtgtgttgtttcatatattcagagtg

SEQ ID NO: 47319 - DNA, 71 bp, chicken (Gallus Gallus)
  misc_feature (36): n=c or t
tcaatagattcctgacaatgtttgctcattgcaggntaatgtaccttcttaagcaacacacacaagattaa

SEQ ID NO: 47320 - DNA, 71 bp, chicken (Gallus Gallus)
  misc_feature (36): n=c or t
tctagtacagaacaacattcaacttgccacataaangttaacatgcatttccaagcccctttcgtatcatg

SEQ ID NO: 47321 - DNA, 71 bp, chicken (Gallus Gallus)
  misc_feature (36): n=c or t
agttgttaggctgctgatgatctgagactaccaacngtcaggttgactggtgttgtcaaagtgttcctcgt

SEQ ID NO: 47322 - DNA, 71 bp, chicken (Gallus Gallus)
  misc_feature (36): n=c or t
tttgtgcaccagtaactctgagtaaaatagttacanccagatggttgcactacttatttcatttagttacc

SEQ ID NO: 47323 - DNA, 71 bp, chicken (Gallus Gallus)
  misc_feature (36): n=a or g
gtgtatatgcctgtaacctgcagaatcaggttacangcatatatacatttacaatgtaaacacgaatgcaa

SEQ ID NO: 47324 - DNA, 71 bp, chicken (Gallus Gallus)
  misc_feature (36): n=g or t
ctttcatttgtcagaattccctacgtatagttgcanatttttgtgaaagataatgaactctggaatcttca

SEQ ID NO: 47325 - DNA, 71 bp, chicken (Gallus Gallus)
  misc_feature (36): n=g or t
acctctctttgaatttacttctgcaaaacttcaggnaaaacatccatctgtcatacttcggttattagcca

SEQ ID NO: 47326 - DNA, 71 bp, chicken (Gallus Gallus)
  misc_feature (36): n=a or g
ggataatttgagtgagtgtttctgtgtataattcanaatctctgagcatctgataatgaataataaattat

SEQ ID NO: 47327 - DNA, 71 bp, chicken (Gallus Gallus)
  misc_feature (36): n=c or t
cacttcttcttacataaaaaggtagtaagttacttnctacctactgtgtccacagcatttagagattcata

SEQ ID NO: 47328 - DNA, 71 bp, chicken (Gallus Gallus)
  misc_feature (36): n=a or g
caaagtgtctgcatctttcagtttttatgttgtgtntaaaatatagtcagatttttgattttgttacctgg

SEQ ID NO: 47329 - DNA, 71 bp, chicken (Gallus Gallus)
  misc_feature (36): n=a or g
tctaaggatatttattggcttaactaacaagacacncctaataatggtgatatgctctgtatcacttccat

SEQ ID NO: 47330 - DNA, 71 bp, chicken (Gallus Gallus)
  misc_feature (36): n=a or g
catcatcaattctgctgttactctccagaacttacntaactagcataaccattatagtaacaacactgcct

SEQ ID NO: 47331 - DNA, 71 bp, chicken (Gallus Gallus)
  misc_feature (36): n=a or g
tctttttaaaataaaaatcattaaggatctggattnctgctagatcattttccgcttatttcagtgtaact

SEQ ID NO: 47332 - DNA, 71 bp, chicken (Gallus Gallus)
  misc_feature (36): n=a or g
aggtagctgatacagaatggggtttctatatacatntaagtagggcctttaacagattattgttagaatag

SEQ ID NO: 47333 - DNA, 71 bp, chicken (Gallus Gallus)
  misc_feature (36): n=c or t
agttctaacatctttattctggaggaagtcttctantggcgtaatagaaagaaggactttagtgtaaaatt

SEQ ID NO: 47334 - DNA, 71 bp, chicken (Gallus Gallus)
  misc_feature (36): n=a or g
accaaatacagagatggatatttatagcaaaaattnaactattttggctgccatctttacatagcaatatc

SEQ ID NO: 47335 - DNA, 71 bp, chicken (Gallus Gallus)
  misc_feature (36): n=a or c
ttgaggtcttaagaattagaatggctttatggaaanatcatgaaaactaatctgtttcagaacagcagcaa

SEQ ID NO: 47336 - DNA, 71 bp, chicken (Gallus Gallus)
  misc_feature (36): n=a or g
aagtaattctatgtctgatcttctgaaaagaagcanagctattttagttttccaaccgaggtggtattaag

SEQ ID NO: 47337 - DNA, 71 bp, chicken (Gallus Gallus)
  misc_feature (36): n=a or g
catttcctcttgcagtacgactaacagtcccactanttataagtccttttaaaggctaaaaagctttcctc

SEQ ID NO: 47338 - DNA, 71 bp, chicken (Gallus Gallus)
  misc_feature (36): n=c or t
aagccattgctatttcagtcggctaggacttcctcnccaagacaacagaaaacccctctgtcctcctttca

SEQ ID NO: 47339 - DNA, 71 bp, chicken (Gallus Gallus)
  misc_feature (36): n=a or g
aacggagttggaagtcttctggcagttggatttgancaggatgaataagaattactggtgaataccgaaca

SEQ ID NO: 47340 - DNA, 71 bp, chicken (Gallus Gallus)
  misc_feature (36): n=c or t
aagaattatgaaaggatgggaaccacaggattcatngtttctctgctcctctgaaggtggtgcattatata

SEQ ID NO: 47341 - DNA, 71 bp, chicken (Gallus Gallus)
  misc_feature (36): n=g or t
cagtgttctcagaattatttcaccattcattgtctncagttagtgacagaaaaacaagatttctcccagtg

SEQ ID NO: 47342 - DNA, 71 bp, chicken (Gallus Gallus)
  misc_feature (36): n=a or g
ccgatcatctgaaagacctatacctgttcctgtatntgccctttcaccatcttggctgcaacaaactacca

SEQ ID NO: 47343 - DNA, 71 bp, chicken (Gallus Gallus)
  misc_feature (36): n=a or g
atccaaagtatgaaatgcttaagcttcagctgaagngttgccattattgtcaaaatgttttgctaatccag

SEQ ID NO: 47344 - DNA, 71 bp, chicken (Gallus Gallus)
  misc_feature (36): n=c or t
tgctgtggtagcaacagtacctaggtctgttagtgnctttagtgtctttaattccctgaggcattactttt

SEQ ID NO: 47345 - DNA, 71 bp, chicken (Gallus Gallus)
  misc_feature (36): n=c or t
aattggatgagtcaaatttgtccagttttaagaagngatggcattttgaatcctaaaattcaatttgcaca

SEQ ID NO: 47346 - DNA, 71 bp, chicken (Gallus Gallus)
  misc_feature (36): n=a or g
agtttcacacaaagtttgagggtatcttttttttcnggtgagggaatgtctaggagcaggggagattacca

SEQ ID NO: 47347 - DNA, 71 bp, chicken (Gallus Gallus)
  misc_feature (36): n=g or t
agttatatatgcagttcttatcagtgcttcatgggnttgggatctgacttaggtcctctctgcaagcagca

SEQ ID NO: 47348 - DNA, 71 bp, chicken (Gallus Gallus)
  misc_feature (36): n=c or t
tgcggtggaatttaatagatgtatttaatggtgtgnatttttactttagtggaagtaggtccatgtttata

SEQ ID NO: 47349 - DNA, 71 bp, chicken (Gallus Gallus)
  misc_feature (36): n=a or g
gtggttgggagtaggaacttgagtacaatatgtcanttctgcattgttatgtaggacacactaaaagatct

SEQ ID NO: 47350 - DNA, 71 bp, chicken (Gallus Gallus)
  misc_feature (36): n=a or g
atatagccatatttggtgtttctagtgagatatgantaaatgaaaatgtattcttatgagttataatgcag

SEQ ID NO: 47351 - DNA, 71 bp, chicken (Gallus Gallus)
  misc_feature (36): n=a or c
tttccttagttgcctacaacttgctctttcagtgcnttctgttaagatgtatgaatagtcaaagtcattga

SEQ ID NO: 47352 - DNA, 71 bp, chicken (Gallus Gallus)
  misc_feature (36): n=a or g
taagaaaattctgattctgaaatcgacaaagaaagnttctcttccaatcagaagggaaattccatgaacag

SEQ ID NO: 47353 - DNA, 71 bp, chicken (Gallus Gallus)
  misc_feature (36): n=a or g
ttcagtgcctgaataatcccttagaggtacaaccangattagttaagagtgggttcatataacaaaattga

SEQ ID NO: 47354 - DNA, 71 bp, chicken (Gallus Gallus)
  misc_feature (36): n=c or t
taacatgcacctaatatctcataggaacaagtatcngtgaaagtgcattccatgaaatcagagagttcatt

SEQ ID NO: 47355 - DNA, 71 bp, chicken (Gallus Gallus)
  misc_feature (36): n=c or t
ttcttcctaaatcaaaaataagaagctgattaaagncataagtaagtgcaatcatgcagttgaagtgtggt

SEQ ID NO: 47356 - DNA, 71 bp, chicken (Gallus Gallus)
  misc_feature (36): n=c or t
agtaaattgttgagaatgacaactcattagaaaaanagatattcactcagttatttaaacttctgaaaata

SEQ ID NO: 47357 - DNA, 71 bp, chicken (Gallus Gallus)
  misc_feature (36): n=a or g
gatggggtaagactgtggtaagatttcagagatttnttatacctcaaattcagaaagagattgacattcat

SEQ ID NO: 47358 - DNA, 71 bp, chicken (Gallus Gallus)
  misc_feature (36): n=a or g
tgatcagtaggatagatgaccttgctcctattttcntctttatcactgctttgagtattaatgtgcagaaa

SEQ ID NO: 47359 - DNA, 71 bp, chicken (Gallus Gallus)
  misc_feature (36): n=c or t
gtaataatgagataaaaattcttttttttttggtgngtgtgtgttagtatcatccattgcagactattaga

SEQ ID NO: 47360 - DNA, 71 bp, chicken (Gallus Gallus)
  misc_feature (36): n=a or g
acagcatcttagctctgaaggagggctatgcatgcntacataaccattgcttgtcctcctcataatttcac

SEQ ID NO: 47361 - DNA, 71 bp, chicken (Gallus Gallus)
  misc_feature (36): n=a or g
tcggaacattcactcttatgacagcaatattcctantgaaacataatgttaaaatgaaacataaaatgaaa

SEQ ID NO: 47362 - DNA, 71 bp, chicken (Gallus Gallus)
  misc_feature (36): n=a or g
acaagggctttctttgttaatcctaaaaactaaatntatattgaccaaatgacagttttgagatgatatga

SEQ ID NO: 47363 - DNA, 71 bp, chicken (Gallus Gallus)
  misc_feature (36): n=c or t
cagctgttattctcattctaattttaatggaattgntttatgtggaatgaacaaaaagtattgccctacag

SEQ ID NO: 47364 - DNA, 71 bp, chicken (Gallus Gallus)
  misc_feature (36): n=a or g
tgtaccctaagatgtattaggctgttgcatattccnaagtggaattcctctcattcctcacattgaaacta

SEQ ID NO: 47365 - DNA, 71 bp, chicken (Gallus Gallus)
  misc_feature (36): n=a or g
tagacagtgtttaacttgactcattatgagctttancaatattgtataaagtgcatagtaatgctagaata

SEQ ID NO: 47366 - DNA, 71 bp, chicken (Gallus Gallus)
  misc_feature (36): n=a or g
gttttaccctgggtgatttatatattaagctacacngcatgagagggatatccattaatgaatatattatt

SEQ ID NO: 47367 - DNA, 71 bp, chicken (Gallus Gallus)
  misc_feature (36): n=c or t
gtgtgcacagatccctgaagaattcccaaagatccngccctgtacttaatatcacagagagtgacatactg

SEQ ID NO: 47368 - DNA, 71 bp, chicken (Gallus Gallus)
  misc_feature (36): n=a or g
cctgagataactacttcacaaaatttattattcagncatttatagagtaatcaggggaagttgtctctact

SEQ ID NO: 47369 - DNA, 71 bp, chicken (Gallus Gallus)
  misc_feature (36): n=a or g
taatttaaagggcaagagagcagaaaaattgtccantgtattcttatctcacatccaaacccaagaacagg

SEQ ID NO: 47370 - DNA, 71 bp, chicken (Gallus Gallus)
  misc_feature (36): n=a or c
ctatgcacccggcacaattataacacaaatacctgnctgacataattcattggcatgtcaagttactttga

SEQ ID NO: 47371 - DNA, 71 bp, chicken (Gallus Gallus)
  misc_feature (36): n=g or t
acaaactgtcaacatttaatttgaatgaaagtaacntctgatttcacttcctttgtcgtaattctttactg

SEQ ID NO: 47372 - DNA, 71 bp, chicken (Gallus Gallus)
  misc_feature (36): n=c or t
ggcttgcattaaacagcttcatttttgatactgcanggacgagcctagtgaactttgggacagtttaatat

SEQ ID NO: 47373 - DNA, 71 bp, chicken (Gallus Gallus)
  misc_feature (36): n=g or t
gcattttttaatgtgctagactaagcatttcctttntttttatcattttcaaacctagtcttattacatct

SEQ ID NO: 47374 - DNA, 71 bp, chicken (Gallus Gallus)
  misc_feature (36): n=a or g
ttggctgtccaagtccaggaccagggcccttcacanaccggccaaggaagcaaagctcacccttatgggct

SEQ ID NO: 47375 - DNA, 71 bp, chicken (Gallus Gallus)
  misc_feature (36): n=a or g
aaaagtgcagtaaactacgagaagcttgacagtgcnttaagctgtgtagtatccccacatacatacttcct

SEQ ID NO: 47376 - DNA, 71 bp, chicken (Gallus Gallus)
  misc_feature (36): n=a or g
caattagcataggttgacaacacagatgagaagtanaatattctggcctctgtataggacacagactgaag

SEQ ID NO: 47377 - DNA, 71 bp, chicken (Gallus Gallus)
  misc_feature (36): n=a or c
caaaaccctattccttaaagctgcattagtaatatntattacagggggagcaagaacatagttttaagaac

SEQ ID NO: 47378 - DNA, 71 bp, chicken (Gallus Gallus)
  misc_feature (36): n=a or g
atccagattacaaagtatgaatgaacaaaggaaacnaaagagagtacctactggggagaggaagagcaagt

SEQ ID NO: 47379 - DNA, 71 bp, chicken (Gallus Gallus)
  misc_feature (36): n=c or t
tttcacctactgctaaagctttccatctctataatncctttgtaattcagaactaccaaacacggtaatat

SEQ ID NO: 47380 - DNA, 71 bp, chicken (Gallus Gallus)
  misc_feature (36): n=a or g
aacataacatttctcctcagagtatttttcctactnggctatcaagcctgaaaatttttgttgagaactgg

SEQ ID NO: 47381 - DNA, 71 bp, chicken (Gallus Gallus)
  misc_feature (36): n=a or g
agttactagtttctaaaaatgatctaatgttagacnagattaagtaaattttgatgtaggaatgttttctg

SEQ ID NO: 47382 - DNA, 71 bp, chicken (Gallus Gallus)
  misc_feature (36): n=a or g
aaacaaaaggatggaagaagggcttagattgaacanatccaattgtttaagtttattgttagcctaaacat

SEQ ID NO: 47383 - DNA, 71 bp, chicken (Gallus Gallus)
  misc_feature (36): n=c or t
tttccaagaggtctgattagacaggtctgactcacntatagttgttataattacaaattgcatgttctgtt

SEQ ID NO: 47384 - DNA, 71 bp, chicken (Gallus Gallus)
  misc_feature (36): n=a or g
tgcaaagtgctaacatctgcagctgtgagtagtaanctgttaaatgtattaattatcattgttttacaaat

SEQ ID NO: 47385 - DNA, 71 bp, chicken (Gallus Gallus)
  misc_feature (36): n=a or g
atactcatgacagtgaattcagaggatgctcggtcnttagatctgggactacattctgaaaatgatgacag

SEQ ID NO: 47386 - DNA, 71 bp, chicken (Gallus Gallus)
  misc_feature (36): n=c or t
cctgaaatgaccatttaacttgatacagcagcctgnttcatacagacaagtgttaataagctgtatgataa

SEQ ID NO: 47387 - DNA, 71 bp, chicken (Gallus Gallus)
  misc_feature (36): n=g or t
gataccattggcttgaacatcactactgaccgatcngtttcatcccttttagaagtatgtgcctcctcatc

SEQ ID NO: 47388 - DNA, 71 bp, chicken (Gallus Gallus)
  misc_feature (36): n=a or g
aaaacaaaacaactccacctgatagagcctgaaaantaagtttaacagttccccttggagcagttttgtct

SEQ ID NO: 47389 - DNA, 71 bp, chicken (Gallus Gallus)
  misc_feature (36): n=g or t
tacaaaagcttgcatgctaaattcatacttcatacncctgagactattattaattcccttacaaaagcagc

SEQ ID NO: 47390 - DNA, 71 bp, chicken (Gallus Gallus)
  misc_feature (36): n=c or t
ttcctaaaagtttagcccacagtactgcccaagagnagaaacattctcacagtggttttgttgtactactg

SEQ ID NO: 47391 - DNA, 71 bp, chicken (Gallus Gallus)
  misc_feature (36): n=c or t
tcctaattataaaatgataagaaaacttgctttacnactcttgtcagattagcactttaaacagggaattg

SEQ ID NO: 47392 - DNA, 71 bp, chicken (Gallus Gallus)
  misc_feature (36): n=a or g
tcacagtcctagatttgttctgcatgggggaacttntcatagacatacatgaacaaaccaacactgggata

SEQ ID NO: 47393 - DNA, 71 bp, chicken (Gallus Gallus)
  misc_feature (36): n=c or t
agaagtgtcattttgaatctagtatgcatttccctngttagattgtctggtaaggttacaattttgtgaac

SEQ ID NO: 47394 - DNA, 71 bp, chicken (Gallus Gallus)
  misc_feature (36): n=c or t
aacagttctgcacttcaaaatactaatcccaatggnttttagaaggaagaacagttttatagaggaaaagg

SEQ ID NO: 47395 - DNA, 71 bp, chicken (Gallus Gallus)
  misc_feature (36): n=a or c
gtttcattgtaagtggtagtatttcaagagaatagnatatagaaggatctgaaaacatttccagcattttt

SEQ ID NO: 47396 - DNA, 71 bp, chicken (Gallus Gallus)
  misc_feature (36): n=c or t
ggaagaaaatattctagaaatgtgtcattctggtgntgttatcctactgctctttaattaaaaggagcttc

SEQ ID NO: 47397 - DNA, 71 bp, chicken (Gallus Gallus)
  misc_feature (36): n=c or t
ggaagaagaatgagactactgtccctctgagaggcnaacactaagacagtgcagggaagcgaagttccttt

SEQ ID NO: 47398 - DNA, 71 bp, chicken (Gallus Gallus)
  misc_feature (36): n=c or t
tacaatgcaaactgttccctgaacctcggtcttaangcagatcactgtatgtgaaaagggaatgtgcttat

SEQ ID NO: 47399 - DNA, 71 bp, chicken (Gallus Gallus)
  misc_feature (36): n=a or c
tgcttccttacaatgcaatgacaaaaatcagctccnttaatctcttgagtgatctgctcttgtggttttcc

SEQ ID NO: 47400 - DNA, 71 bp, chicken (Gallus Gallus)
  misc_feature (36): n=c or t
ttaaacaattggtttcattctcagggcaactgtggncttcaggatgactatacatggtgtccaattattcc

SEQ ID NO: 47401 - DNA, 71 bp, chicken (Gallus Gallus)
  misc_feature (36): n=c or t
cacacacatatatggtcagttgtgttttgcttgtcngccctatttcctctttctgacttttacagtagcca

SEQ ID NO: 47402 - DNA, 71 bp, chicken (Gallus Gallus)
  misc_feature (36): n=c or t
tatcagtggggttacaatgttggctgctgttgactncactaagctctgtgcttatcagcttttgaagactt

SEQ ID NO: 47403 - DNA, 71 bp, chicken (Gallus Gallus)
  misc_feature (36): n=a or g
aaagtagggtaaagtagaaagaggctgttttaaagnacaggatttgcctgaccatctcctgcttttaattc

SEQ ID NO: 47404 - DNA, 71 bp, chicken (Gallus Gallus)
  misc_feature (36): n=a or g
cagaggcttagcaattgctactgattataggataanggaagctgctaaaagcaggggattgcttcatgcag

SEQ ID NO: 47405 - DNA, 71 bp, chicken (Gallus Gallus)
  misc_feature (36): n=a or g
cttactattaagtaattgcaggaagattctttacantgtctttatctatgtcttcatcagcttcaaaacag

SEQ ID NO: 47406 - DNA, 71 bp, chicken (Gallus Gallus)
  misc_feature (36): n=c or t
ttgaatttcattatagcatttcctcttattagactnccaatactgcataatgggctgatgaacataaagtg

SEQ ID NO: 47407 - DNA, 71 bp, chicken (Gallus Gallus)
  misc_feature (36): n=c or t
acggaatctccagaggtgcctcagacagcctgctantgcacactccgttgtcacaattgctgaaaatacct

SEQ ID NO: 47408 - DNA, 71 bp, chicken (Gallus Gallus)
  misc_feature (36): n=a or g
aagaactgcctgaatggacttgaagtctaacagaancatatattatgtctgtactctgtaggaccattgca

SEQ ID NO: 47409 - DNA, 71 bp, chicken (Gallus Gallus)
  misc_feature (36): n=a or g
attattcaccatgttcagtatttgagagatgtttgntctaacacaaaactagtacaagaatatgttaactg

SEQ ID NO: 47410 - DNA, 71 bp, chicken (Gallus Gallus)
  misc_feature (36): n=g or t
tttttggttaatcgttagatatctaaattgttccangccagttaagttcattcctttggcggattttgctc

SEQ ID NO: 47411 - DNA, 71 bp, chicken (Gallus Gallus)
  misc_feature (36): n=c or t
actgggaaagagaccactaccctgtaaatcacaatnagaataatctctgtactatgatacctcaaaatgct

SEQ ID NO: 47412 - DNA, 71 bp, chicken (Gallus Gallus)
  misc_feature (36): n=a or g
gacactgcttagataaataaggttaaccttgtgtanattactgctgcccgaactctttttcatgagtacat

SEQ ID NO: 47413 - DNA, 71 bp, chicken (Gallus Gallus)
  misc_feature (36): n=a or g
caagattcattgaattggatcataaaagatacactnttaatacattcatagcatatctgcaacacaatatt

SEQ ID NO: 47414 - DNA, 71 bp, chicken (Gallus Gallus)
  misc_feature (36): n=c or t
gaaatcacagtttcatacagacaaaattcacgacanactgaagaaacaaaaatcttttaatataataaata

SEQ ID NO: 47415 - DNA, 71 bp, chicken (Gallus Gallus)
  misc_feature (36): n=a or g
tgtcttttaactgaaaatctctctttggtacttttnccatgtattcctccactagtctctaaaaacatgac

SEQ ID NO: 47416 - DNA, 71 bp, chicken (Gallus Gallus)
  misc_feature (36): n=a or g
aaataaacactagcaggagtttcaatcaaagtatgntgtatgcttctgaggcaaaaggatgcaccttagga

SEQ ID NO: 47417 - DNA, 71 bp, chicken (Gallus Gallus)
  misc_feature (36): n=c or t
tccctagtgaaaaacattgcagcaattatgaaacanaaaaacagtaagtgctcttaataattattaaacaa

SEQ ID NO: 47418 - DNA, 71 bp, chicken (Gallus Gallus)
  misc_feature (36): n=c or t
ggtagatatggaaacaagaaatttgtagtgaattanatttctcatgaaataacatttatgaatagtcttgc

SEQ ID NO: 47419 - DNA, 71 bp, chicken (Gallus Gallus)
  misc_feature (36): n=a or g
ccccaattcaaaccttccttcctccacacaggatgncagcaaacttgttggggtggaattgaaaattttct

SEQ ID NO: 47420 - DNA, 71 bp, chicken (Gallus Gallus)
  misc_feature (36): n=c or t
gtgctttattttactgttgccactgtcctttgtttnatctgaccactgcagctcacttgggctcatgtcct

SEQ ID NO: 47421 - DNA, 71 bp, chicken (Gallus Gallus)
  misc_feature (36): n=c or t
ccattgttattatatggaatttctaagcaagtatcntttaaatcacactagctgcttgatcagcatttatt

SEQ ID NO: 47422 - DNA, 71 bp, chicken (Gallus Gallus)
  misc_feature (36): n=c or t
taccagttttaaaagacagaagtctaccctcctccnattgcaattactcttccttggagcatgcagcatcc

SEQ ID NO: 47423 - DNA, 71 bp, chicken (Gallus Gallus)
  misc_feature (36): n=a or g
tgtgacctggaaaaagaatctgaatcatatggaacnaaggttatgtttaatttacacctggaaggaaaaaa

SEQ ID NO: 47424 - DNA, 71 bp, chicken (Gallus Gallus)
  misc_feature (36): n=a or g
gaagtgcaaaaaaattgcctatgaagaaagacaacngaagaagaaatcaacagatgaaataccacagtgaa

SEQ ID NO: 47425 - DNA, 71 bp, chicken (Gallus Gallus)
  misc_feature (36): n=a or g
gtaggcaactactgttagtctaaactatctattacntgaatcagctgaatttctgatgcaatgaacttact

SEQ ID NO: 47426 - DNA, 71 bp, chicken (Gallus Gallus)
  misc_feature (36): n=c or t
aaatctggaaacataaagctgttcatttggcttagnaaactaacactgaagtctgtcagactatccatgaa

SEQ ID NO: 47427 - DNA, 71 bp, chicken (Gallus Gallus)
  misc_feature (36): n=c or t
acttacacagattttagtataaccttaagacactcngatacatcccttagtactgctgatatctgtttact

SEQ ID NO: 47428 - DNA, 71 bp, chicken (Gallus Gallus)
  misc_feature (36): n=c or t
taaataccaggagaaattagtgaactatagcaatgnaccagagttgagaattgcaaactacaacaagcagg

SEQ ID NO: 47429 - DNA, 71 bp, chicken (Gallus Gallus)
  misc_feature (36): n=a or g
atagcagtaggtacagtcataacttggagtatgccnaagcaaaagcagtatgagttaaagaaaataaacta

SEQ ID NO: 47430 - DNA, 71 bp, chicken (Gallus Gallus)
  misc_feature (36): n=c or t
atcaaacttcacagtctgcatgaaagtgaattcctnatcttaggagacttctagccctgaaacctaccaga

SEQ ID NO: 47431 - DNA, 71 bp, chicken (Gallus Gallus)
  misc_feature (36): n=c or t
aagcattagatattgagcatcagtgtctggtagtgntggggagcagactggcaaccaggcagactggtgac

SEQ ID NO: 47432 - DNA, 71 bp, chicken (Gallus Gallus)
  misc_feature (36): n=a or g
tggggagaacagacgtctgggaaaaggaaatgcacncaggatctgtagagcctgtctcaggctcacttagt

SEQ ID NO: 47433 - DNA, 71 bp, chicken (Gallus Gallus)
  misc_feature (36): n=a or g
agagagacatgccatcttctattcctattcaagacncttcccttttaacacttatggtactttagaagtac

SEQ ID NO: 47434 - DNA, 71 bp, chicken (Gallus Gallus)
  misc_feature (36): n=c or t
aggcccattattatagtaaggatgttactgtagacnagttaaagacacatctgtcattgcatgaccatccc

SEQ ID NO: 47435 - DNA, 71 bp, chicken (Gallus Gallus)
  misc_feature (36): n=a or g
tggtatttgcccacagtgactgcgcgctctttgctngaggagtcaataccactttgctccaaaccatttct

SEQ ID NO: 47436 - DNA, 71 bp, chicken (Gallus Gallus)
  misc_feature (36): n=c or t
tcactctttccccgttagtttcctgttgcagccctntgatatagtagtaatggttactcacctgcacagca

SEQ ID NO: 47437 - DNA, 71 bp, chicken (Gallus Gallus)
  misc_feature (36): n=a or g
tgtcttcagtaagggatacaaggcaggactacagcnccttaacatggagctgtgtagcttctctctgtctg

SEQ ID NO: 47438 - DNA, 71 bp, chicken (Gallus Gallus)
  misc_feature (36): n=a or g
ttctatgtaagaactgtaaggtgcaagcaacagatncagcagctgaattgtgcatcatgctggtgtggtgt

SEQ ID NO: 47439 - DNA, 71 bp, chicken (Gallus Gallus)
  misc_feature (36): n=a or g
ataaataaatataacacaaacatatgattctgaccncattgaaaaggaatctgtaggtaaaaaaaacctaa

SEQ ID NO: 47440 - DNA, 71 bp, chicken (Gallus Gallus)
  misc_feature (36): n=c or t
cttaagaaatggagtaaaaaggcagttaaggtttcngcatctctacttacattctgaagtctgaaacctga

SEQ ID NO: 47441 - DNA, 71 bp, chicken (Gallus Gallus)
  misc_feature (36): n=a or g
ctgcgatttttctccctctgatggatctctgattantgccgctgaagcctgagaaactgacagacggatgt

SEQ ID NO: 47442 - DNA, 71 bp, chicken (Gallus Gallus)
  misc_feature (36): n=c or t
atccaatctgacagagtctttcacactggggaagtntgtgttggatttggccggggactgcttcccaggat

SEQ ID NO: 47443 - DNA, 71 bp, chicken (Gallus Gallus)
  misc_feature (36): n=a or g
aaatactgacccaggcgtatgtctctccagaaatanccagaatatgacatgcagaagacctgtggtctgtc

SEQ ID NO: 47444 - DNA, 71 bp, chicken (Gallus Gallus)
  misc_feature (36): n=a or c
acaggtcacttgattctattttgaactcgaaggaantggcagtctggacatttgtcttggatagaaatgta

SEQ ID NO: 47445 - DNA, 71 bp, chicken (Gallus Gallus)
  misc_feature (36): n=a or g
aggacagcatagtaggatggaggtaggtccatcaanccacagtgataggcaggcccatggaccagtggcag

SEQ ID NO: 47446 - DNA, 71 bp, chicken (Gallus Gallus)
  misc_feature (36): n=c or t
ataagctcctcagccctccattaacccatcagttanttattcatgttacctccagaggaaaaatgggaagg

SEQ ID NO: 47447 - DNA, 71 bp, chicken (Gallus Gallus)
  misc_feature (36): n=c or t
cttgatctctggtatggcccacattagataggctgntgcacattcataagcactctttgtttactttgtaa

SEQ ID NO: 47448 - DNA, 71 bp, chicken (Gallus Gallus)
  misc_feature (36): n=a or g
aactttaaacaagatgctgagaatgggtgctgagcngagtgctgggtggggaacaggcttccatctcagaa

SEQ ID NO: 47449 - DNA, 71 bp, chicken (Gallus Gallus)
  misc_feature (36): n=c or t
tagtaaaaaatttatgtatacatacactgtgggaanagaggaatatatgtagctgagagagggcattgcca

SEQ ID NO: 47450 - DNA, 71 bp, chicken (Gallus Gallus)
  misc_feature (36): n=c or t
agcagagccagggagctgctttgtgactgcctgacngaggggactgtgaggaaagcactggggtgacattt

SEQ ID NO: 47451 - DNA, 71 bp, chicken (Gallus Gallus)
  misc_feature (36): n=g or t
atgacaacaaaaaactgtattcaatttgcttgattnaatcatagaaactaaagacaatgaaaataaaaatt

SEQ ID NO: 47452 - DNA, 71 bp, chicken (Gallus Gallus)
  misc_feature (36): n=g or t
gttctcaaactcatttgccagtagttgcttgtatgngtgggaacagcagaaatggatggtgtagaagtata

SEQ ID NO: 47453 - DNA, 71 bp, chicken (Gallus Gallus)
  misc_feature (36): n=c or t
atatagtgacagaaatggtgaaatgccaagaataangcattacatgagaacaggtatcaggctgtgaatgc

SEQ ID NO: 47454 - DNA, 71 bp, chicken (Gallus Gallus)
  misc_feature (36): n=a or g
ggcttacattagtttcacttacgagatataaagctntattttaagaatttcacaaaaagaccagaaagcta

SEQ ID NO: 47455 - DNA, 71 bp, chicken (Gallus Gallus)
  misc_feature (36): n=a or g
agattttgttcatcttcagtgtccctgaggcatacntggagcatgctggaagtggagtgtcaggagtgttt

SEQ ID NO: 47456 - DNA, 71 bp, chicken (Gallus Gallus)
  misc_feature (36): n=a or g
gaattctgaatgtaagatgcaaaaataatctgcatngtgaaagctgaagataagagtcaaagattacccag

SEQ ID NO: 47457 - DNA, 71 bp, chicken (Gallus Gallus)
  misc_feature (36): n=c or t
tcaattgaaagtcaacatagttaagctgaaaatgtntctggaaatgtttaaaagtctccattttttataag

SEQ ID NO: 47458 - DNA, 71 bp, chicken (Gallus Gallus)
  misc_feature (36): n=a or g
acatgcaagtaatattggcagcacaaaccactagtntcatcataagaatggttcaagagaagtcaggaggg

SEQ ID NO: 47459 - DNA, 71 bp, chicken (Gallus Gallus)
  misc_feature (36): n=c or t
ggcaccctaagtatctcactaggacaaactgtgatngtctccaaaggagccctcaaaagatgtggacatct

SEQ ID NO: 47460 - DNA, 71 bp, chicken (Gallus Gallus)
  misc_feature (36): n=a or c
taagaatgacaccactatgcatgcctcccacattantttttctggttattgacacacagctgcactaaatc

SEQ ID NO: 47461 - DNA, 71 bp, chicken (Gallus Gallus)
  misc_feature (36): n=c or t
ttccctgagatgtctgggtaagagccacctctgagngcaagtccttgctgctatactgtacaaccactggt

SEQ ID NO: 47462 - DNA, 71 bp, chicken (Gallus Gallus)
  misc_feature (36): n=c or t
cttgcaaagttttaggaccctgtagtccaagaagcnaaaaaagagatcacatgtgcaaaatattgtttcag

SEQ ID NO: 47463 - DNA, 71 bp, chicken (Gallus Gallus)
  misc_feature (36): n=a or g
acagcaagatacaagggtagaaggatagaagaaggnaagtatgagcatgcaagtgagggggcataccaagc

SEQ ID NO: 47464 - DNA, 71 bp, chicken (Gallus Gallus)
  misc_feature (36): n=c or t
ttgcaatagtatgacacaggcagataagtacggcgntgacaatatacatcagttccacaactgtcaatact

SEQ ID NO: 47465 - DNA, 71 bp, chicken (Gallus Gallus)
  misc_feature (36): n=a or g
ttactactcttgttgaattttaagtacaagcttaangatggtgctttgcgatattagtaatctgggccatt

SEQ ID NO: 47466 - DNA, 71 bp, chicken (Gallus Gallus)
  misc_feature (36): n=a or c
tctctcctgcacattcacctaactatgaagaaattnacagtgcaccccattttccctgctgcaccccacat

SEQ ID NO: 47467 - DNA, 71 bp, chicken (Gallus Gallus)
  misc_feature (36): n=a or g
cggtgctctgtgaaagtgatggggagccaggctganctgggtgctaatggggggagatgggtgggaggctg

SEQ ID NO: 47468 - DNA, 71 bp, chicken (Gallus Gallus)
  misc_feature (36): n=a or c
ggcaactgtagaagaactcagcaaaaggaagtatcnaaactagtcaaaattacattgcagaaaaatgaatg

SEQ ID NO: 47469 - DNA, 71 bp, chicken (Gallus Gallus)
  misc_feature (36): n=c or t
aatagtacaccaaaagcactgcactaacagactganatctgctggcctacggagatggtagtgcactaaat

SEQ ID NO: 47470 - DNA, 71 bp, chicken (Gallus Gallus)
  misc_feature (36): n=a or c
tccttgctcagtaacagaagttatcgaagaggagcnacagagctgctctttccttgccctgcagtaagtta

SEQ ID NO: 47471 - DNA, 71 bp, chicken (Gallus Gallus)
  misc_feature (36): n=g or t
aaatttggtaacaatcagcatatttggctcactcanttttgactactttttctccatccagagaaggttct

SEQ ID NO: 47472 - DNA, 71 bp, chicken (Gallus Gallus)
  misc_feature (36): n=c or t
tagggttcagtttttccagatattcccctggagcangaagctttggaaggaagctgtggttaaccactgat

SEQ ID NO: 47473 - DNA, 71 bp, chicken (Gallus Gallus)
  misc_feature (36): n=g or t
ttgttacattaactgacgttattttttggttctccntcagcatttttagggctctgaatcctgcttgtaca

SEQ ID NO: 47474 - DNA, 71 bp, chicken (Gallus Gallus)
  misc_feature (36): n=a or g
ctaaagagaacacctggatggacaaagttgatatangtggacaagtcttctgcaaatgtcttggatgaagc

SEQ ID NO: 47475 - DNA, 71 bp, chicken (Gallus Gallus)
  misc_feature (36): n=c or t
cacatcaaacaacatcttttcaaggacttccttgantgcaaattgactcactgttgtaactgctgttgacg

SEQ ID NO: 47476 - DNA, 71 bp, chicken (Gallus Gallus)
  misc_feature (36): n=a or g
ggtaccacatctttatgagaggcaagtaaggcttanctgtcacctcccatttacattgcaccatgtaagta

SEQ ID NO: 47477 - DNA, 71 bp, chicken (Gallus Gallus)
  misc_feature (36): n=a or g
acaggtattggaaaacaggaaattttatcttttccngtgcgtatatggcttgaatcagtggtacagcagat

SEQ ID NO: 47478 - DNA, 71 bp, chicken (Gallus Gallus)
  misc_feature (36): n=a or g
ttgctctttgctatgccctcacttgttgcttgtaangaaagcactgttttatagcattcttgtagtgatac

SEQ ID NO: 47479 - DNA, 71 bp, chicken (Gallus Gallus)
  misc_feature (36): n=c or t
tgcccacagtgctttttaaggtgtctgcattcatanggtgaacaatttcatgttatgctgcttctcctctt

SEQ ID NO: 47480 - DNA, 71 bp, chicken (Gallus Gallus)
  misc_feature (36): n=c or t
aaaatccatttcctgacatcccattcccagggacanttccaagcaggttgtgttgtcaaaatacctttaat

SEQ ID NO: 47481 - DNA, 71 bp, chicken (Gallus Gallus)
  misc_feature (36): n=a or g
tccagaacaaactggtatatttagctggcagtctcnttaagaatctaaaactttgttaagtcataacatac

SEQ ID NO: 47482 - DNA, 71 bp, chicken (Gallus Gallus)
  misc_feature (36): n=a or g
tagagcctagtcctcagaaaaattctgtagtggcangaatacatggtcaaaagacaacatactggaaatag

SEQ ID NO: 47483 - DNA, 71 bp, chicken (Gallus Gallus)
  misc_feature (36): n=a or c
ggagcatgcccagcagagatgataacattcaatagnactgcccaggacattgcacagaggcacaggaagag

SEQ ID NO: 47484 - DNA, 71 bp, chicken (Gallus Gallus)
  misc_feature (36): n=a or g
tcttggaagaaagccttgctcccttgaatgtttgcncacagcgtaggttgccaattccagcaaacctaagc

SEQ ID NO: 47485 - DNA, 71 bp, chicken (Gallus Gallus)
  misc_feature (36): n=c or t
cgaaccttatgtacatccttcttttctatcatatgntgttctgtgttctatatctagccactgtactaatg

SEQ ID NO: 47486 - DNA, 71 bp, chicken (Gallus Gallus)
  misc_feature (36): n=g or t
ctctgctaattgttatcttagcttctgaaccgagangagggaaacagaagtggccttatttctagcagtga

SEQ ID NO: 47487 - DNA, 71 bp, chicken (Gallus Gallus)
  misc_feature (36): n=c or t
cctgcctgtgggagagcagggatgcttctccatcgntgtcagcagctctttttccaatgatgtcattctcc

SEQ ID NO: 47488 - DNA, 71 bp, chicken (Gallus Gallus)
  misc_feature (36): n=a or g
tgcacctcctgggaggaccccatctacagccacacncctgggaaactcctatggtgtaattctaagttctg

SEQ ID NO: 47489 - DNA, 71 bp, chicken (Gallus Gallus)
  misc_feature (36): n=c or t
aacatggcaatagaaagcctctccatcaacaagcanaggcaccagccagaagtgaaagccacatggtgctc

SEQ ID NO: 47490 - DNA, 71 bp, chicken (Gallus Gallus)
  misc_feature (36): n=a or g
tctggttttaatgaaaatatgtaaattatacagggntgagaatctagttggagtgcattgttacatctcct

SEQ ID NO: 47491 - DNA, 71 bp, chicken (Gallus Gallus)
  misc_feature (36): n=c or t
ctaaccactcctaatgctatggcacagtcagaccanggtgcacctcccgtctgcaaacagccctgggaagc

SEQ ID NO: 47492 - DNA, 71 bp, chicken (Gallus Gallus)
  misc_feature (36): n=a or c
ttgctcagtttatctatcagcaatcctaaacatcanaaaacaagatttaccaaaatcacataacaaagctg

SEQ ID NO: 47493 - DNA, 71 bp, chicken (Gallus Gallus)
  misc_feature (36): n=c or t
caaccattgactgactgtgttcctgtaaaatacttntgagttcaaatgaacaatcagaagcaactacatat

SEQ ID NO: 47494 - DNA, 71 bp, chicken (Gallus Gallus)
  misc_feature (36): n=c or t
ggggttttcttgattaggtgactggaaattaaaaangtagtactgcctttgaaatttcagaagctaagctg

SEQ ID NO: 47495 - DNA, 71 bp, chicken (Gallus Gallus)
  misc_feature (36): n=g or t
tttacagtcttgtgaaatattcaaaattaatctgtntagggggtgtatccattgttagttatgttagaggt

SEQ ID NO: 47496 - DNA, 71 bp, chicken (Gallus Gallus)
  misc_feature (36): n=a or g
actgcagcaaaatagctggtttaaaccctttctgtngaagtgaaatgttcataaaagagcaactctgacaa

SEQ ID NO: 47497 - DNA, 71 bp, chicken (Gallus Gallus)
  misc_feature (36): n=c or t
agataatgctatacttcctcatcctgaggcaaatgncttgtatacatgtttcttctgcactttcattagtc

SEQ ID NO: 47498 - DNA, 71 bp, chicken (Gallus Gallus)
  misc_feature (36): n=c or t
ctacaataattcgtacacctcagtcaagaggaaaanccacgtgaaccaaataagcaagaattgctcgcatg

SEQ ID NO: 47499 - DNA, 71 bp, chicken (Gallus Gallus)
  misc_feature (36): n=c or t
aagagcaagtacagggtgttccttctgagatacacngatcagttctgcaaacactgcttaaacgatatcca

SEQ ID NO: 47500 - DNA, 71 bp, chicken (Gallus Gallus)
  misc_feature (36): n=c or t
tttcttccactggtgtatagttttttttagcttttnaccttttcctgcagcatattgagaagttctgtagc

SEQ ID NO: 47501 - DNA, 71 bp, chicken (Gallus Gallus)
  misc_feature (36): n=a or g
tattccttctgcattcctgtttcaccaagtcccacntatctgcctgccttggtgcaggggacacctgacac

SEQ ID NO: 47502 - DNA, 71 bp, chicken (Gallus Gallus)
  misc_feature (36): n=a or g
ggacatagtcatatgcattaccagtcctcaaccctngaacctattctggtctggagaagatggtggttcag

SEQ ID NO: 47503 - DNA, 71 bp, chicken (Gallus Gallus)
  misc_feature (36): n=c or t
acaaacatttgctgaaagctttgcttagcagaatgnactgtagatgcatcatgatttcttttctaaacaca

SEQ ID NO: 47504 - DNA, 71 bp, chicken (Gallus Gallus)
  misc_feature (36): n=a or g
gtgacagggagatggcaaattgctcactgaagcacntattagaagccaccaaggatctaaaacattgttct

SEQ ID NO: 47505 - DNA, 71 bp, chicken (Gallus Gallus)
  misc_feature (36): n=c or t
taggcacctcagcagtcgtcatctgaaatgaagcanctccatgtgcagctgggctcacagccctcagcccc

SEQ ID NO: 47506 - DNA, 71 bp, chicken (Gallus Gallus)
  misc_feature (36): n=c or t
aataaataatgagtaattcaagcccatctggatgtntgggtacatgacagggaatgtactgtaactaacgg

SEQ ID NO: 47507 - DNA, 71 bp, chicken (Gallus Gallus)
  misc_feature (36): n=a or g
tgcatagatacagtaagtgaatatggtaaagcaganggcagctcatggcaaagacgaggacacctgcctgg

SEQ ID NO: 47508 - DNA, 71 bp, chicken (Gallus Gallus)
  misc_feature (36): n=g or t
gggtcctgccttctctcatcagctcttgaagacttngtggcactcctgtctgtaggaagctggcagtttag

SEQ ID NO: 47509 - DNA, 71 bp, chicken (Gallus Gallus)
  misc_feature (36): n=c or t
ccttctgatctgcagctaaaatctggcctccaaacngtggttgctctggatctgtgcatgtaaaagctatc

SEQ ID NO: 47510 - DNA, 71 bp, chicken (Gallus Gallus)
  misc_feature (36): n=a or g
gggttaagggtgatgaagttggtgttgctgatctcngggaacagatgtagaaactgaggcacacaacattt

SEQ ID NO: 47511 - DNA, 71 bp, chicken (Gallus Gallus)
  misc_feature (36): n=c or t
tgctctcagcacatgtaaagcttactggctattcangatcattttgcaataaaggatgagctatggctatt

SEQ ID NO: 47512 - DNA, 71 bp, chicken (Gallus Gallus)
  misc_feature (36): n=a or g
tcataactctctgaacactctgcttgtagtggaggngttgtaccacccactgtgtgagacgtactggaaca

SEQ ID NO: 47513 - DNA, 71 bp, chicken (Gallus Gallus)
  misc_feature (36): n=a or c
tgaagcttcagctttgagctgcaagtgcagtgttgntgagaaacaaagtggcatctgtctattctggtttc

SEQ ID NO: 47514 - DNA, 71 bp, chicken (Gallus Gallus)
  misc_feature (36): n=c or t
atctggggtatgtgggtggaaaaattcacagtgttntgaatcagaatacagcagtggagtggaaaaaggga

SEQ ID NO: 47515 - DNA, 71 bp, chicken (Gallus Gallus)
  misc_feature (36): n=c or t
tgggaattagagtacatagtatgtttgtgaagtttnctgcagagactgtctgatagcacccactactccaa

SEQ ID NO: 47516 - DNA, 71 bp, chicken (Gallus Gallus)
  misc_feature (36): n=g or t
ctgtcacacctgcacatgtagctccagctgatgaancaaattgttcctaaaaaattagcagaaactgctca

SEQ ID NO: 47517 - DNA, 71 bp, chicken (Gallus Gallus)
  misc_feature (36): n=c or t
tcctacagttttgttctggaagagaagcaggtatcngttgccaaatatatgatcaactcctgaccttacat

SEQ ID NO: 47518 - DNA, 71 bp, chicken (Gallus Gallus)
  misc_feature (36): n=g or t
ctgtagagacagacttttggatcagctggctttccntttactgttaaaatttgaacacatacactcacaaa

SEQ ID NO: 47519 - DNA, 71 bp, chicken (Gallus Gallus)
  misc_feature (36): n=c or t
aaaaagagcctattcagttgttttcaacaagatctnctattttgttaaccacatctactgtggcacaagtt

SEQ ID NO: 47520 - DNA, 71 bp, chicken (Gallus Gallus)
  misc_feature (36): n=c or t
gtaattgatggcaaagaacagataaaaacaaagttnaaaacacataatagatgagggaggaaacaaatgac

SEQ ID NO: 47521 - DNA, 71 bp, chicken (Gallus Gallus)
  misc_feature (36): n=g or t
tgtgcttaagtggtacttcacaccatgggggtttgntataagtaagttctcaggactgaagccgagtagtt

SEQ ID NO: 47522 - DNA, 71 bp, chicken (Gallus Gallus)
  misc_feature (36): n=a or g
tggtttcccaggtattcaacaagatgctgtttcctngaactaatcattgattgtgcaaatcactgactgta

SEQ ID NO: 47523 - DNA, 71 bp, chicken (Gallus Gallus)
  misc_feature (36): n=c or t
actgatctttgtaaatgtgggaactttgctgattanaggagaaagccctgctttttgcaatgaaaagtgaa

SEQ ID NO: 47524 - DNA, 71 bp, chicken (Gallus Gallus)
  misc_feature (36): n=a or g
tctcagccctgtatggagatatttttatcttctccntgggccagtctccaatcttcattatcacgatcttt

SEQ ID NO: 47525 - DNA, 71 bp, chicken (Gallus Gallus)
  misc_feature (36): n=c or t
ctccagactcttgatataaatgttgccttaatttgnaaaaaggagggtttttcagtgacatctgtagagat

SEQ ID NO: 47526 - DNA, 71 bp, chicken (Gallus Gallus)
  misc_feature (36): n=c or t
gtagagactgatccaggaacatgtatctgctaattntggcacttaacaaagcccagcattacacctgcctt

SEQ ID NO: 47527 - DNA, 71 bp, chicken (Gallus Gallus)
  misc_feature (36): n=a or c
cttttcagtcctgaagacaccattacaagcatgctnccctgctagaacttaaaagcacacctctgcactga

SEQ ID NO: 47528 - DNA, 71 bp, chicken (Gallus Gallus)
  misc_feature (36): n=a or g
taaaacgaaggattctaatatcacaaatctcaccgngatgacaccatgtgttcacatccatattcttctac

SEQ ID NO: 47529 - DNA, 71 bp, chicken (Gallus Gallus)
  misc_feature (36): n=a or g
tcacagtaacaaaataccaagctcagtgtttctcanagagtctttatagcctgtgttaaaacttcattaag

SEQ ID NO: 47530 - DNA, 71 bp, chicken (Gallus Gallus)
  misc_feature (36): n=a or g
agatctacctaaagtatgccgttcccttgtaccatntattgcattatgtaaactccaccaacatatacaga

SEQ ID NO: 47531 - DNA, 71 bp, chicken (Gallus Gallus)
  misc_feature (36): n=a or g
agaaaaccaactaattgccataggtgcctaaaatcncttgatttcttgctcctgactagcatgcctgtaat

SEQ ID NO: 47532 - DNA, 71 bp, chicken (Gallus Gallus)
  misc_feature (36): n=c or t
atcaggttacagaattatcttgtaagtataagcatncaaataatcattgctaaagagataataaagagact

SEQ ID NO: 47533 - DNA, 71 bp, chicken (Gallus Gallus)
  misc_feature (36): n=c or t
aatactcccacataaagcagaactggcagagaaaangtattgctaagtcagcctggggaatgccacaaaga

SEQ ID NO: 47534 - DNA, 71 bp, chicken (Gallus Gallus)
  misc_feature (36): n=a or g
gtcatttcccactactctttttaataatttacctcnactgtcaaacgttatcattcacacagtatacatta

SEQ ID NO: 47535 - DNA, 71 bp, chicken (Gallus Gallus)
  misc_feature (36): n=a or c
attcctctcttaggtagagacaaaatttgtggcaantgcattgtatccagacctgacggcttgcccagttt

SEQ ID NO: 47536 - DNA, 71 bp, chicken (Gallus Gallus)
  misc_feature (36): n=c or t
actgatgactgtattgtgtatgtaaagtgggagtanttcctgtgtgtttagaatagtttcgaaaactacta

SEQ ID NO: 47537 - DNA, 71 bp, chicken (Gallus Gallus)
  misc_feature (36): n=a or g
cttaggctgagaaaagagcatgccttggctattggncattgagacaaaatgctcaggaagcagaccaaatc

SEQ ID NO: 47538 - DNA, 71 bp, chicken (Gallus Gallus)
  misc_feature (36): n=a or g
gacatgctgatggggcagttcatgcgtcagagtganctgtgccctcgtgaaacaaacacgcctttttcctc

SEQ ID NO: 47539 - DNA, 71 bp, chicken (Gallus Gallus)
  misc_feature (36): n=a or c
ctaccctacctttctccagctatcactgtccccttncagcctccctcactgatctcccttgacatctccta

SEQ ID NO: 47540 - DNA, 71 bp, chicken (Gallus Gallus)
  misc_feature (36): n=a or g
cctctatttatgcagccaactctcatcacactgttntattttttgttgaaattatttcatcaggaaataat

SEQ ID NO: 47541 - DNA, 71 bp, chicken (Gallus Gallus)
  misc_feature (36): n=a or g
atggtgaaaggtattgcagaaagaatgaaatgcagntgattctttccccatctgtttttggttggaagagc

SEQ ID NO: 47542 - DNA, 71 bp, chicken (Gallus Gallus)
  misc_feature (36): n=a or g
tctcattctcacgcaggctgccagagttgcacaganaatttgagtgtaactgtgttaattcctaaggcaca

SEQ ID NO: 47543 - DNA, 71 bp, chicken (Gallus Gallus)
  misc_feature (36): n=c or t
gggataggaggagcacgaggtgggagtgaagtgctnggaagtcccccctcccaacctaatagaggtgtgca

SEQ ID NO: 47544 - DNA, 71 bp, chicken (Gallus Gallus)
  misc_feature (36): n=a or g
aatgccggcaaaataagtcccgttctggacagtgtntttaatcttagtagtattgcactgaagtactgtat

SEQ ID NO: 47545 - DNA, 71 bp, chicken (Gallus Gallus)
  misc_feature (36): n=a or g
tgattatttcatagatacagtcgtttaagttaagtntactttaagttttttatccacaatattgcacatgc

SEQ ID NO: 47546 - DNA, 71 bp, chicken (Gallus Gallus)
  misc_feature (36): n=a or g
gctgcatgccattgctaggaaaagtgaaatgaccancatttttcatgcttcatgacaaataaggatgtgtt

SEQ ID NO: 47547 - DNA, 71 bp, chicken (Gallus Gallus)
  misc_feature (36): n=c or t
aggtctcatggcagatagtggatatcctaaagctanagatttctaaacaaataacaagacatgattgtgga

SEQ ID NO: 47548 - DNA, 71 bp, chicken (Gallus Gallus)
  misc_feature (36): n=c or t
aaactgtgctggtacactgttagccaacactactangatcacttggttgctgctctccttaactactgatt

SEQ ID NO: 47549 - DNA, 71 bp, chicken (Gallus Gallus)
  misc_feature (36): n=a or g
ctaattgcagaattgcacagtttcctctcctgggcntcctttggagcagcatagacctggatcacagcgga

SEQ ID NO: 47550 - DNA, 71 bp, chicken (Gallus Gallus)
  misc_feature (36): n=a or g
tctgctgcagaattatatagaggtagagtttggggnaaacctgctattttcaccacatttgcttctccttt

SEQ ID NO: 47551 - DNA, 71 bp, chicken (Gallus Gallus)
  misc_feature (36): n=c or t
cttttgttctaggaaagatagtgaggctatttcacntgcagtgccatcactgtgctagcctcatgcagcat

SEQ ID NO: 47552 - DNA, 71 bp, chicken (Gallus Gallus)
  misc_feature (36): n=c or t
gttgctttgtgttttggtcggctcctcctttgtttngtactcacaatttctctttgccttatgttcttata

SEQ ID NO: 47553 - DNA, 71 bp, chicken (Gallus Gallus)
  misc_feature (36): n=c or t
ttcagctctacttgatttcttatccccactgctttnctaatacattatcttagattaacagtgagatctct

SEQ ID NO: 47554 - DNA, 71 bp, chicken (Gallus Gallus)
  misc_feature (36): n=g or t
aaggtgtcttcttgattgaatctgaaccagcttagnaagatgacagctcctcaggttttattcccacagag

SEQ ID NO: 47555 - DNA, 71 bp, chicken (Gallus Gallus)
  misc_feature (36): n=a or g
tcctgcccaacaactgctttatcaatttgttacagnacagtatgggaaaagtaaagattacatttaaacag

SEQ ID NO: 47556 - DNA, 71 bp, chicken (Gallus Gallus)
  misc_feature (36): n=a or g
tcgtcaacacaccatagagtcagctcatgtataagnaggtattctaagagtgtagtggcagtaagtaggaa

SEQ ID NO: 47557 - DNA, 71 bp, chicken (Gallus Gallus)
  misc_feature (36): n=a or g
taactctgtaggctttgagagtaggtcaaatagggntatagtaggttgtagtttagttctatgtcagagct

SEQ ID NO: 47558 - DNA, 71 bp, chicken (Gallus Gallus)
  misc_feature (36): n=g or t
gcacaacaaaagtgctgttaccagtgggggggaatngagcattagagcagcagctgggattgtgtgttagt

SEQ ID NO: 47559 - DNA, 71 bp, chicken (Gallus Gallus)
  misc_feature (36): n=g or t
taaattcagattgctgtccttgttctcctgtagacnttctatttcttgctaaggcctagtacaatgtaact

SEQ ID NO: 47560 - DNA, 71 bp, chicken (Gallus Gallus)
  misc_feature (36): n=c or t
gccctggaaaaggatctttcatcattctattctaanacttgtgaagtttctatttcagctgagaacttctc

SEQ ID NO: 47561 - DNA, 71 bp, chicken (Gallus Gallus)
  misc_feature (36): n=a or g
gataatttgaaccctcttgcctacagagtgaacgcnttaaaagaagcactcaagaacaccagactacctat

SEQ ID NO: 47562 - DNA, 71 bp, chicken (Gallus Gallus)
  misc_feature (36): n=a or g
cacagtgctgcatgggcccagctgctcagtcccacntaagccaaatggacgtcctcaaaaagagcagcata

SEQ ID NO: 47563 - DNA, 71 bp, chicken (Gallus Gallus)
  misc_feature (36): n=c or t
tgtgctgccagctatggaaagacagtgtgaacagtntttgaggctccatgcatctaaaaaatggttttatc

SEQ ID NO: 47564 - DNA, 71 bp, chicken (Gallus Gallus)
  misc_feature (36): n=c or t
aaataaaggacataaataattgcaatgctaacccantacaagtgtaccacagaagaaaacactggtatttt

SEQ ID NO: 47565 - DNA, 71 bp, chicken (Gallus Gallus)
  misc_feature (36): n=a or g
tatgaaagatcttggaggaggaaagcgaagactttntttatctgtattcattgaaataattgtggagattt

SEQ ID NO: 47566 - DNA, 71 bp, chicken (Gallus Gallus)
  misc_feature (36): n=c or t
ctactgctttctaataatccatttcatgagataaanagttacactgcaaactgaagattctgttagtcaaa

SEQ ID NO: 47567 - DNA, 71 bp, chicken (Gallus Gallus)
  misc_feature (36): n=a or g
tcactactcttaacataccagagtctccctttgctncttgtgtgtatggaaccgtaggttattttgctaaa

SEQ ID NO: 47568 - DNA, 71 bp, chicken (Gallus Gallus)
  misc_feature (36): n=c or t
ctctgcgcaggatgtccctctccgcagcgaaatctntctctccgtgtgacgggcggttggggtgcgtgcga

SEQ ID NO: 47569 - DNA, 71 bp, chicken (Gallus Gallus)
  misc_feature (36): n=a or g
gcaaatagatttattgggtttgcgttatttagcccngtcccttcctggaaacgcttatttatggggaggaa

SEQ ID NO: 47570 - DNA, 71 bp, chicken (Gallus Gallus)
  misc_feature (36): n=c or t
atgcagttgtcgatctgcataagggcagatgaacantatgtgcaagatctcactgttgtaccctgatctgc

SEQ ID NO: 47571 - DNA, 71 bp, chicken (Gallus Gallus)
  misc_feature (36): n=a or g
tctggggatttttcaggtcaagcaggaggttctgtncctatgtcactccgctgcctatcatcccatgtgaa

SEQ ID NO: 47572 - DNA, 71 bp, chicken (Gallus Gallus)
  misc_feature (36): n=c or t
ggaatcttttttgcagacttttatcatgcccactcntataatgtattataaatcattaccttcccactcag

SEQ ID NO: 47573 - DNA, 71 bp, chicken (Gallus Gallus)
  misc_feature (36): n=a or g
tgttttgattcataatttcttagtagattgctgcanaatcttgtcattgggacatttttattttattcact

SEQ ID NO: 47574 - DNA, 71 bp, chicken (Gallus Gallus)
  misc_feature (36): n=g or t
ccatgttaaatcttccaaggttgtcaacagcaaganaaatttcaagcactgcagtttaagaagattatata

SEQ ID NO: 47575 - DNA, 71 bp, chicken (Gallus Gallus)
  misc_feature (36): n=a or g
gtattcgcataaaaatctcaaactcaaagcatgtanagtctgggagtgtacctggtgagctaacacatata

SEQ ID NO: 47576 - DNA, 71 bp, chicken (Gallus Gallus)
  misc_feature (36): n=c or t
gacatttggttaagcagaaactacgtgctatagganacaactgcagatagctgcttgacatatgtttgtgt

SEQ ID NO: 47577 - DNA, 71 bp, chicken (Gallus Gallus)
  misc_feature (36): n=c or t
cactgcaggactgagggcagtagcacagctggctcncagctcagcccttattaccaacaccaattattggt

SEQ ID NO: 47578 - DNA, 71 bp, chicken (Gallus Gallus)
  misc_feature (36): n=a or c
gcattttaaattgcctcagagccaaacgaagacaanacaaaatgttctctttgtgacctgaaagaacaagc

SEQ ID NO: 47579 - DNA, 71 bp, chicken (Gallus Gallus)
  misc_feature (36): n=c or t
gagtgcctcctcccctcaggctgtgcagcgtcatcntgtggagtgcattgatgctgcccaagtaaccatct

SEQ ID NO: 47580 - DNA, 71 bp, chicken (Gallus Gallus)
  misc_feature (36): n=c or t
tttggttgttaagttacaagaaattgtattacacgnctgtatcatgctgaagattttgcagacctagtgag

SEQ ID NO: 47581 - DNA, 71 bp, chicken (Gallus Gallus)
  misc_feature (36): n=a or g
ctttgcagaaaagtttcccttcagaaaattatctcngaacacatattgatggcaaagaaggtttactccag

SEQ ID NO: 47582 - DNA, 71 bp, chicken (Gallus Gallus)
  misc_feature (36): n=c or t
attcttagctagcgcttggccatggcacgtgcaagngctgtgccttacactctgtggcaaaaactgagaag

SEQ ID NO: 47583 - DNA, 71 bp, chicken (Gallus Gallus)
  misc_feature (36): n=c or t
tatagatgtaagaaggcaaactcactaactatacanacaccaccatttgtgtagctactctaacaggtatt

SEQ ID NO: 47584 - DNA, 71 bp, chicken (Gallus Gallus)
  misc_feature (36): n=a or g
tcttgtgattagaaactagaattgcattgcgtctcncactgaatcttcatgcagtttgtgatcagtctgtg

SEQ ID NO: 47585 - DNA, 71 bp, chicken (Gallus Gallus)
  misc_feature (36): n=g or t
catgatctcacgattcagagggaaataaacaaatangaagggcagagcagtcagaatacaatcatcgatga

SEQ ID NO: 47586 - DNA, 71 bp, chicken (Gallus Gallus)
  misc_feature (36): n=g or t
cagcactgtcctactgatgtaggctatgcatgaatntgactgtggccaaagtacatcctggaaaaaaaaaa

SEQ ID NO: 47587 - DNA, 71 bp, chicken (Gallus Gallus)
  misc_feature (36): n=a or g
gtattttagacctcttgtggcaaagttgcacatggngaaggagctgcatttagcttcaaaaaggcttagat

SEQ ID NO: 47588 - DNA, 71 bp, chicken (Gallus Gallus)
  misc_feature (36): n=a or g
ggtgcctaaaagcagaacacaagtttgaatgttgcnaaacctgtgacacaaaaatatcactaattttcctg

SEQ ID NO: 47589 - DNA, 71 bp, chicken (Gallus Gallus)
  misc_feature (36): n=c or t
gactcaagaatgaaactcagaaacagccctcacttntagcacaatgcaactttgggacatcgtggaaaatc

SEQ ID NO: 47590 - DNA, 71 bp, chicken (Gallus Gallus)
  misc_feature (36): n=a or g
tgtgatgcactacgattggtaattttcttattccangttttgaaagacaattttccaaagttgcaagcaga

SEQ ID NO: 47591 - DNA, 71 bp, chicken (Gallus Gallus)
  misc_feature (36): n=a or g
cagataaacatttttattgccagaacagaattgcantatctggttctaaagagtcatatcatgctattatt

SEQ ID NO: 47592 - DNA, 71 bp, chicken (Gallus Gallus)
  misc_feature (36): n=a or g
ttttcagtgaaatagaaggtacaggcagtaaaggcntggaaataatttcagatataatggaataattttgt

SEQ ID NO: 47593 - DNA, 71 bp, chicken (Gallus Gallus)
  misc_feature (36): n=g or t
catacttacttattttgcctattctgagattaaaanaaaccttctcaacatatgagtattttttttcaata

SEQ ID NO: 47594 - DNA, 71 bp, chicken (Gallus Gallus)
  misc_feature (36): n=c or t
tttcaaaaccaaaatggagtttataccttccttacngatggtattctggaccattttcctctgcagaatct

SEQ ID NO: 47595 - DNA, 71 bp, chicken (Gallus Gallus)
  misc_feature (36): n=c or t
cctgtaattaaacctatagtataacctctttacccnacatgaagcactttcttgcactgttgtacaacact

SEQ ID NO: 47596 - DNA, 71 bp, chicken (Gallus Gallus)
  misc_feature (36): n=a or c
atgacaagtgtgttgcatcagagcctctttcagtgnagatcaggaaaataagcttgcaaaaaaacacacgg

SEQ ID NO: 47597 - DNA, 71 bp, chicken (Gallus Gallus)
  misc_feature (36): n=a or g
ttcatcatctgagagcaggtcaaaaaacaaaccatngtgggtattttggaatgcaatgcctttttgatcag

SEQ ID NO: 47598 - DNA, 71 bp, chicken (Gallus Gallus)
  misc_feature (36): n=a or g
actacggctctgtacacagcccatcacatatcacanctacattgcttagggtgggctgtgagaagcagaga

SEQ ID NO: 47599 - DNA, 71 bp, chicken (Gallus Gallus)
  misc_feature (36): n=a or c
aaggcagtagagatgactgagattactccataaaanaagagaactaaagattattgttttacagttacttc

SEQ ID NO: 47600 - DNA, 71 bp, chicken (Gallus Gallus)
  misc_feature (36): n=c or t
cttaggtgcctgggaggacatggatgccatggcttnggctagaaaggaaggcagacaaagattatttaaaa

SEQ ID NO: 47601 - DNA, 71 bp, chicken (Gallus Gallus)
  misc_feature (36): n=a or g
acagctaatccaggctgggtaggatgtgccttctcntagatggatcttatgtggcctcctccagactcttg

SEQ ID NO: 47602 - DNA, 71 bp, chicken (Gallus Gallus)
  misc_feature (36): n=c or t
ttttagaaacaaagaaaatagctgcagagaacaccnaggaatgttaagaaatgtcttttaattaatgtagt

SEQ ID NO: 47603 - DNA, 71 bp, chicken (Gallus Gallus)
  misc_feature (36): n=g or t
ctccttatgtcacataatccctaaagatgccatttnatgccatctggcttttgttgttattcccaatcaga

SEQ ID NO: 47604 - DNA, 71 bp, chicken (Gallus Gallus)
  misc_feature (36): n=c or t
ctgcaaagaaagagagtatttaacaattctgaaaanggcaggcatttagaagagtagcagacctggtgtct

SEQ ID NO: 47605 - DNA, 71 bp, chicken (Gallus Gallus)
  misc_feature (36): n=c or t
ttatggccttatatttgttcacgtatggattgagcncatgctttatcatccttgagcaaaaaattggttgc

SEQ ID NO: 47606 - DNA, 71 bp, chicken (Gallus Gallus)
  misc_feature (36): n=c or t
ccaactcctcagaaatttacctgtaaacatcagcanagccgattggatatgagacattacagctttgccaa

SEQ ID NO: 47607 - DNA, 71 bp, chicken (Gallus Gallus)
  misc_feature (36): n=a or g
tcagttcaaagtggtctgattcagaaggtagaggtnagctgagcaactttgtggtggaaacaagaacactt

SEQ ID NO: 47608 - DNA, 71 bp, chicken (Gallus Gallus)
  misc_feature (36): n=c or t
agacaaaatatttcagtgagtgctgaatgcaaaggntggatgcatatattttcagctggctcacatgacct

SEQ ID NO: 47609 - DNA, 71 bp, chicken (Gallus Gallus)
  misc_feature (36): n=c or t
gatcacaacaacactcggagaaatgaaagacaatangttctgacaggattttgcgctttctcctggttgta

SEQ ID NO: 47610 - DNA, 71 bp, chicken (Gallus Gallus)
  misc_feature (36): n=a or g
cgtgcatgggatgcggttactgtcactgctccactnccctcggtccggttccttcatcccagtgggaggtt

SEQ ID NO: 47611 - DNA, 71 bp, chicken (Gallus Gallus)
  misc_feature (36): n=a or g
agtatttttgacttttgaattaagagatgacgtacnccatacttcaagagattctttaaatgtagtgaact

SEQ ID NO: 47612 - DNA, 71 bp, chicken (Gallus Gallus)
  misc_feature (36): n=c or t
cctgcagctccttgcagtttgaagctaattgttttngtcaggatgggaacgtctggaagtccatggcagca

SEQ ID NO: 47613 - DNA, 71 bp, chicken (Gallus Gallus)
  misc_feature (36): n=g or t
agcagtgtgatgctgggcacacacactggggcatcntcaggaatgcatgagaagaaatgtcccatcttcac

SEQ ID NO: 47614 - DNA, 71 bp, chicken (Gallus Gallus)
  misc_feature (36): n=c or t
tagagcagaaaaatccactcccaccatataacaaangtgggctttatgtgggtgtaaggaagcactcaagg

SEQ ID NO: 47615 - DNA, 71 bp, chicken (Gallus Gallus)
  misc_feature (36): n=c or t
gatcttacgtgtcataacacagcctgccactctacngcacattcaagctaacaagcaagcagggcagcatt

SEQ ID NO: 47616 - DNA, 71 bp, chicken (Gallus Gallus)
  misc_feature (36): n=g or t
tagggctttgtggggttgctgaatagtgaacagaanaagtagcctcagactccatcttagaggctctcgag

SEQ ID NO: 47617 - DNA, 71 bp, chicken (Gallus Gallus)
  misc_feature (36): n=a or g
cactctgctgtcacctagggcatgggatggtgatgnacatacagtcattttcacaggaaagccatacaatg

SEQ ID NO: 47618 - DNA, 71 bp, chicken (Gallus Gallus)
  misc_feature (36): n=a or g
gtaactattcagcagaaattggtgtcatactatgtngagtaaaatagatgtcactataaatataattcaat

SEQ ID NO: 47619 - DNA, 71 bp, chicken (Gallus Gallus)
  misc_feature (36): n=a or c
aaagattcaagcctaacttcatgcagacaccaaaanggagatggaaataaagcacaaggatttcagcatct

SEQ ID NO: 47620 - DNA, 71 bp, chicken (Gallus Gallus)
  misc_feature (36): n=a or g
ggtgttttaagttaacattattaaacaacactgaantcaaaaagcagtcatctgatattactttagatgtt

SEQ ID NO: 47621 - DNA, 71 bp, chicken (Gallus Gallus)
  misc_feature (36): n=a or g
cctggtttggtcattcatactaatataacactgtanatatcaggagattaattacagccagtatccatgaa

SEQ ID NO: 47622 - DNA, 71 bp, chicken (Gallus Gallus)
  misc_feature (36): n=a or g
ggtttttacttagtggtttgacaagtggcctgaacngggtcaaaggagtagttcttaaaatgtgaattatt

SEQ ID NO: 47623 - DNA, 71 bp, chicken (Gallus Gallus)
  misc_feature (36): n=c or t
catgaaaacagttcgtggatattaattaaaaattcngtgagtggttctgacataggcagtttgagagacaa

SEQ ID NO: 47624 - DNA, 71 bp, chicken (Gallus Gallus)
  misc_feature (36): n=c or t
tcaaatatactaaacaaaggatgctacaaatttccngtagtttacctgaaaagaggtgaccatgcaaagaa

SEQ ID NO: 47625 - DNA, 71 bp, chicken (Gallus Gallus)
  misc_feature (36): n=a or g
gtggttttatatacagatttattactataatgcacntgtatgaatgtatatatgcactcacataaatacag

SEQ ID NO: 47626 - DNA, 71 bp, chicken (Gallus Gallus)
  misc_feature (36): n=c or t
tgcatattttttcatgtagcacgtatttattatctnattacttgagacataagttattctgtttattgtaa

SEQ ID NO: 47627 - DNA, 71 bp, chicken (Gallus Gallus)
  misc_feature (36): n=g or t
gttatttaaaatgtttggtacacttagaaatgttancaagtagcattatagttctagatcattatcacaga

SEQ ID NO: 47628 - DNA, 71 bp, chicken (Gallus Gallus)
  misc_feature (36): n=g or t
atgaaagcactatcagtcccttctgcctgttaaaangatgaatgaactgatcccagagctggtagtcttct

SEQ ID NO: 47629 - DNA, 71 bp, chicken (Gallus Gallus)
  misc_feature (36): n=a or c
acatcatcaataaacaagagctgtaaactctactgnaaacattgtgctattagagaaaacaatcgatattt

SEQ ID NO: 47630 - DNA, 71 bp, chicken (Gallus Gallus)
  misc_feature (36): n=c or t
ccttccatctgttcagtagattaaaatgtaattgtngcagttcataagctgcaagagaaaagcactctttc

SEQ ID NO: 47631 - DNA, 71 bp, chicken (Gallus Gallus)
  misc_feature (36): n=a or g
gattagatgctgtcgatggacagcaggtgacaggcntgagatagcatgaaagcattctccaagtcactaga

SEQ ID NO: 47632 - DNA, 71 bp, chicken (Gallus Gallus)
  misc_feature (36): n=g or t
gacaacaagaaaaattcctatcacaacattcaatanatgaagagagagattactcttttgacacattgttc

SEQ ID NO: 47633 - DNA, 71 bp, chicken (Gallus Gallus)
  misc_feature (36): n=c or t
cttaaaagtgtggatgattgcaccaggtaaattttnactgctctgctgatatcttttgctttaaaatttag

SEQ ID NO: 47634 - DNA, 71 bp, chicken (Gallus Gallus)
  misc_feature (36): n=a or g
atacaaaacaaatcctttctctcagaagctgtgatnctaagctgaaaccaatgcttgcttgttttgttgtt

SEQ ID NO: 47635 - DNA, 71 bp, chicken (Gallus Gallus)
  misc_feature (36): n=c or t
atttattattaacatcaacgtttgcatttacatctnggaatatcttgtactaagcatttaacatgtggtta

SEQ ID NO: 47636 - DNA, 71 bp, chicken (Gallus Gallus)
  misc_feature (36): n=g or t
tacacaactgctgtattttttaccatctgtatacanattcccattcttaaatgccaaatctttcttacttc

SEQ ID NO: 47637 - DNA, 71 bp, chicken (Gallus Gallus)
  misc_feature (36): n=c or t
ttcatagtgcagagcatgtgtgtaaggtatgtattnctttggagagaactcaatgagcacactatctagaa

SEQ ID NO: 47638 - DNA, 71 bp, chicken (Gallus Gallus)
  misc_feature (36): n=g or t
gctgcattcctagagcaactctgccagagcagagtnacttcatttatcagataatgtactttaagctgcag

SEQ ID NO: 47639 - DNA, 71 bp, chicken (Gallus Gallus)
  misc_feature (36): n=c or t
tcataaaatatatatcaggaacagaaatgaaatcanggacaagaacactttaataaaatagttctgagatt

SEQ ID NO: 47640 - DNA, 71 bp, chicken (Gallus Gallus)
  misc_feature (36): n=a or g
aggatgcagagacaagaaatgacaaacagaggagangcaggcagggcagtgtagttacagtaaacaagaga

SEQ ID NO: 47641 - DNA, 71 bp, chicken (Gallus Gallus)
  misc_feature (36): n=a or g
catcctttatatgaaataccatattggtctaaaatnatcttgcatcacttcaatacatatcaatagactgt

SEQ ID NO: 47642 - DNA, 71 bp, chicken (Gallus Gallus)
  misc_feature (36): n=a or g
ttatttgcaagtagtgctgcagaataaaggcagccncacacctgaagatgtgtcctgcagtacctaaggac

SEQ ID NO: 47643 - DNA, 71 bp, chicken (Gallus Gallus)
  misc_feature (36): n=c or t
tagctgaaataacagattacaaagggctgtgctagngagaacatccctgctgatgttctgataaagactag

SEQ ID NO: 47644 - DNA, 71 bp, chicken (Gallus Gallus)
  misc_feature (36): n=a or c
cgataataatgcaagtcaggataaaattatcagagnttcccaacttcccaagtcaaagcccaagtcaatgt

SEQ ID NO: 47645 - DNA, 71 bp, chicken (Gallus Gallus)
  misc_feature (36): n=a or g
aaaggggaaagaaaactagcgtcaagtagaaacagngatatgggatttgggaaggttgtcttctctattct

SEQ ID NO: 47646 - DNA, 71 bp, chicken (Gallus Gallus)
  misc_feature (36): n=a or g
ttgataaagtttcttcattctcttaagagagtaacnctgtcacatatgagtgattctgctgtgtttctgta

SEQ ID NO: 47647 - DNA, 71 bp, chicken (Gallus Gallus)
  misc_feature (36): n=a or g
caatgcttctgtttgggcagctttctggaagtgtgnctattgctgacttccattttgatcagtcctagcct

SEQ ID NO: 47648 - DNA, 71 bp, chicken (Gallus Gallus)
  misc_feature (36): n=a or g
tctgctgatctctgtttccctgcataggttgacacngataaaataacactcgtgtgtacagttcactgctt

SEQ ID NO: 47649 - DNA, 71 bp, chicken (Gallus Gallus)
  misc_feature (36): n=c or t
acttcaactgcactctaagctctgttgagacccccntaagctggatccaaacaagtgagacatcatcgtaa

SEQ ID NO: 47650 - DNA, 71 bp, chicken (Gallus Gallus)
  misc_feature (36): n=a or g
gcagttgcccatttcaaatctgcattgtttggacangcttttcgttaagtatctcacttgcagttgaacat

SEQ ID NO: 47651 - DNA, 71 bp, chicken (Gallus Gallus)
  misc_feature (36): n=c or t
tgtttctggcaaaatcagccctggttctgtactccnttcaatgtgttctctttgttcttccagataaaaaa

SEQ ID NO: 47652 - DNA, 71 bp, chicken (Gallus Gallus)
  misc_feature (36): n=c or t
cctggtaacgcatccaggtgttccaccagtgcatgnatgagggaaaatctgagttccaagttcagtaactt

SEQ ID NO: 47653 - DNA, 71 bp, chicken (Gallus Gallus)
  misc_feature (36): n=a or g
actagctgaaacccacaactaccagttgaatgtacncacagagaatccattgctgtagcacagcatgaaaa

SEQ ID NO: 47654 - DNA, 71 bp, chicken (Gallus Gallus)
  misc_feature (36): n=c or t
caaaggtcaaaacgatgggaggggatggaaaagggnttcctatatcattttggcatttgtcatcttctcag

SEQ ID NO: 47655 - DNA, 71 bp, chicken (Gallus Gallus)
  misc_feature (36): n=c or t
ctgcatccacttctatgcctttgtgactgaatatcnaaaggaaacttgagaatccttgcagtgagaagcag

SEQ ID NO: 47656 - DNA, 71 bp, chicken (Gallus Gallus)
  misc_feature (36): n=a or g
tgcactgtggaatcacatctgacttgagactccacnctggtcagtgctgcattaacatgcgcgctgatcta

SEQ ID NO: 47657 - DNA, 71 bp, chicken (Gallus Gallus)
  misc_feature (36): n=c or t
cttggagtagtttgaaagtctgtgattgactttttnatagtgtggctgaattttagtctctttctggagct

SEQ ID NO: 47658 - DNA, 71 bp, chicken (Gallus Gallus)
  misc_feature (36): n=a or g
tgtaatgaagaagtgctcatgtggtcagacaccagngtgagagctgttttgttatgtcactgtgcagcagg

SEQ ID NO: 47659 - DNA, 71 bp, chicken (Gallus Gallus)
  misc_feature (36): n=c or t
caagcaaagactggtgagatactacatctcatgttnaacaaacacaacctaactgtttcacacaacctgag

SEQ ID NO: 47660 - DNA, 71 bp, chicken (Gallus Gallus)
  misc_feature (36): n=c or t
aagtatcagtcagtagtttcttcccctctgccatgnttgaaagagagcaaagagataagatggaaaaggaa

SEQ ID NO: 47661 - DNA, 71 bp, chicken (Gallus Gallus)
  misc_feature (36): n=a or g
ggaaaaggttatgcattacagcacttcgctaagtgntgcctttactcatagattgtctaagcaaataaaac

SEQ ID NO: 47662 - DNA, 71 bp, chicken (Gallus Gallus)
  misc_feature (36): n=c or t
aatcattcatcactggaaaagatgggctttgttggntttaagaataaaaaatcattcatcagtaaaggaaa

SEQ ID NO: 47663 - DNA, 71 bp, chicken (Gallus Gallus)
  misc_feature (36): n=c or t
aataaagctgttctgtctttaccagaaattgtgctngggctcttccttaccatagatcaccacatgagctc

SEQ ID NO: 47664 - DNA, 71 bp, chicken (Gallus Gallus)
  misc_feature (36): n=a or g
cgaccaaaaatcaaaaccagaactcaccaagttatncatgatcttaagtcagtttgggaggttgtctgtgg

SEQ ID NO: 47665 - DNA, 71 bp, chicken (Gallus Gallus)
  misc_feature (36): n=a or g
aagcaagaaccagcatgaagcagctggttttactantttaagggaaaaccccaaccagctgttaccatcaa

SEQ ID NO: 47666 - DNA, 71 bp, chicken (Gallus Gallus)
  misc_feature (36): n=g or t
ctgcattcagatgtgtggactttaacaatttcaatntttccaatccatgcaactcaaaatgctgaaaaatt

SEQ ID NO: 47667 - DNA, 71 bp, chicken (Gallus Gallus)
  misc_feature (36): n=c or t
cagtccttctgcacaacatttaagtaggactgcctngctagagtgaattatagctatctcccaatatagtc

SEQ ID NO: 47668 - DNA, 71 bp, chicken (Gallus Gallus)
  misc_feature (36): n=a or g
ctatttgctggggttctcattaaattagtcacaganaacagctattgaagaactacctggaggtacttcta

SEQ ID NO: 47669 - DNA, 71 bp, chicken (Gallus Gallus)
  misc_feature (36): n=c or t
cttctacaagcctggtatcacagtataagaaatgangtgaaggtggcaaaaaagacccctgacttttctga

SEQ ID NO: 47670 - DNA, 71 bp, chicken (Gallus Gallus)
  misc_feature (36): n=c or t
ctttaaaacagactgtgctggataatagatttccanctgatgtaactctacgaagtggactttaatgaaga

SEQ ID NO: 47671 - DNA, 71 bp, chicken (Gallus Gallus)
  misc_feature (36): n=a or g
agctgctgaccgtggatgactcctccagtatgctgncagtgggtcccaaaggtaacttatttaaaggccct

SEQ ID NO: 47672 - DNA, 71 bp, chicken (Gallus Gallus)
  misc_feature (36): n=c or t
aatgctttctgcaaacgatgagaagagactaggacnggtcactcctattaatgtctaagcagtgggatttt

SEQ ID NO: 47673 - DNA, 71 bp, chicken (Gallus Gallus)
  misc_feature (36): n=a or g
gtaatcctcatctttttaggtactagagtataacanatgcagatagtatggaagtttaaattttacacatg

SEQ ID NO: 47674 - DNA, 71 bp, chicken (Gallus Gallus)
  misc_feature (36): n=c or t
acatttacatctcttattcattctaaaggccaatanatagctggcttagtaagtacttttgaaatgccatg

SEQ ID NO: 47675 - DNA, 71 bp, chicken (Gallus Gallus)
  misc_feature (36): n=c or t
gggtgcagcagtctgagatgggcaccttccctgccnttacacccttattcccagctctcgcagggaactgg

SEQ ID NO: 47676 - DNA, 71 bp, chicken (Gallus Gallus)
  misc_feature (36): n=c or t
gagtatgtaccccataggtccagtgggaaaatactngctaagagcctaaggccaaaagaattccctacctg

SEQ ID NO: 47677 - DNA, 71 bp, chicken (Gallus Gallus)
  misc_feature (36): n=c or t
tttgtaattgtagaatagaaggggatagaggagaangcatttctcagccctaccctgttttggcatcctgc

SEQ ID NO: 47678 - DNA, 71 bp, chicken (Gallus Gallus)
  misc_feature (36): n=a or g
gcagtttaattaaagaaaatcgtcaacctcagtatnaaagtgcatttttaattaccttatcgaggatgttt

SEQ ID NO: 47679 - DNA, 71 bp, chicken (Gallus Gallus)
  misc_feature (36): n=c or t
gttgagatctctgcatttacttacatttacttactnagggtaatcttgagatcactcttgacctctctgaa

SEQ ID NO: 47680 - DNA, 71 bp, chicken (Gallus Gallus)
  misc_feature (36): n=a or g
ctggtaagaatgtttccccttgaacttttcagattnctttctttgtcaccagaaatgcctacaaagttaag

SEQ ID NO: 47681 - DNA, 71 bp, chicken (Gallus Gallus)
  misc_feature (36): n=c or t
cattctacacacagtacatcactccttcctctttgntggatgtgtaaagtactacagtaacaatgtattta

SEQ ID NO: 47682 - DNA, 71 bp, chicken (Gallus Gallus)
  misc_feature (36): n=a or c
atgttttccttaattacaattccaaggctttaaaancacagggtagagagtagggcttcctcagttgtatc

SEQ ID NO: 47683 - DNA, 71 bp, chicken (Gallus Gallus)
  misc_feature (36): n=c or t
gtggagttagttctgttgtaccaagagacaacaacntgtgcctgtgtgcagagagcctccctgcaggaggt

SEQ ID NO: 47684 - DNA, 71 bp, chicken (Gallus Gallus)
  misc_feature (36): n=a or g
catcacttttactgtctccctcagttgagtgctgcntggttaaatagaatctgttacctcccagaaatggc

SEQ ID NO: 47685 - DNA, 71 bp, chicken (Gallus Gallus)
  misc_feature (36): n=a or c
cgtacatgcctttccagaggggctgaacaaccatgntgtggttgacttgacttaaagatacagatgcttag

SEQ ID NO: 47686 - DNA, 71 bp, chicken (Gallus Gallus)
  misc_feature (36): n=a or g
gaaatcttaggccacaccatcaaaatctgatgtccntatttataaacataactctatgaaagaacagacct

SEQ ID NO: 47687 - DNA, 71 bp, chicken (Gallus Gallus)
  misc_feature (36): n=c or t
caaaaaaccaagagggccaatctggccaggacactngtctgtccatgtcttctgcttcacagtttttactg

SEQ ID NO: 47688 - DNA, 71 bp, chicken (Gallus Gallus)
  misc_feature (36): n=c or t
tattactttaataccagttctgcaagggtactgatnatagtcttttactacacaacttcatactttgcttt

SEQ ID NO: 47689 - DNA, 71 bp, chicken (Gallus Gallus)
  misc_feature (36): n=a or c
agcatgaccgttcctgtaatactttatgttccctcntgacgggcggttggaagagccaacagcaccagcat

SEQ ID NO: 47690 - DNA, 71 bp, chicken (Gallus Gallus)
  misc_feature (36): n=a or g
cagttaaagcagtagtgcttaggtatcattgaaacntgggagtagattctgttatctagtgataatctggc

SEQ ID NO: 47691 - DNA, 71 bp, chicken (Gallus Gallus)
  misc_feature (36): n=a or g
agctcctccataggttctcttcagcattctcaggcnatttctgtattacaaaggatgcctgcagactgccc

SEQ ID NO: 47692 - DNA, 71 bp, chicken (Gallus Gallus)
  misc_feature (36): n=c or t
taaataaattacatacatagtcgagctagaaaatanacacaaaactaaaggacattaaagtcctttaatca

SEQ ID NO: 47693 - DNA, 71 bp, chicken (Gallus Gallus)
  misc_feature (36): n=c or t
ctccaccagctctaagctttcctatttccactgctnggcaacatgactgtgagtgtcagccataccacagc

SEQ ID NO: 47694 - DNA, 71 bp, chicken (Gallus Gallus)
  misc_feature (36): n=a or g
tgaatagctaagccaggcaattaatgatgctgacanatcatatttggggacattatttaaccaagaggctt

SEQ ID NO: 47695 - DNA, 71 bp, chicken (Gallus Gallus)
  misc_feature (36): n=c or t
tcttttttctacagggtcagaatgggtaggcttttntgtaaaggtcatacaggatttttattacactggtc

SEQ ID NO: 47696 - DNA, 71 bp, chicken (Gallus Gallus)
  misc_feature (36): n=a or g
tcttccctcctcacacacactaattgctgcagtccntacaaagggatattgcaagtgtgactctgtctggc

SEQ ID NO: 47697 - DNA, 71 bp, chicken (Gallus Gallus)
  misc_feature (36): n=a or g
aaagtcgcttccttgtctacatgctctcatatctgntatattatatcttgccttcttcagtatagctgtta

SEQ ID NO: 47698 - DNA, 71 bp, chicken (Gallus Gallus)
  misc_feature (36): n=a or g
ccctgcgtgcatttagatcaaaacatgtcgtaaacnacactgcagctgacaggcagtgagggagcttttat

SEQ ID NO: 47699 - DNA, 71 bp, chicken (Gallus Gallus)
  misc_feature (36): n=c or t
aattatctagatctcaacaatataacctttctgccnatttctaaaatgacccaagttttgtcttcttgata

SEQ ID NO: 47700 - DNA, 71 bp, chicken (Gallus Gallus)
  misc_feature (36): n=c or t
cgccctggcagcccgacaggaggcaaccgtaccctngcaaagcaagagccctcacttttcagagtgagaaa

SEQ ID NO: 47701 - DNA, 71 bp, chicken (Gallus Gallus)
  misc_feature (36): n=c or t
tgggtttcgaagaacactgttgtgaactttccttcnatgagtagccacagtgacagtggggaagaaagctg

SEQ ID NO: 47702 - DNA, 71 bp, chicken (Gallus Gallus)
  misc_feature (36): n=a or g
ttgcataatttgtgcacagccttgacacttttatangaaaataccttctgcaatgttgttgctgtatgtat

SEQ ID NO: 47703 - DNA, 71 bp, chicken (Gallus Gallus)
  misc_feature (36): n=a or c
actaggtctttctaaatacaagtgttttactgatanaggagaatattttaaactaacaagtatcacatacc

SEQ ID NO: 47704 - DNA, 71 bp, chicken (Gallus Gallus)
  misc_feature (36): n=a or g
acaaatgtcaattgctaaatgtgtttgaaaacagantttagggtacactggcaaatgaaagaagcaaacaa

SEQ ID NO: 47705 - DNA, 71 bp, chicken (Gallus Gallus)
  misc_feature (36): n=c or t
tcccaaatatgagtaaaatttcactgctttcaacangggaaaggctctggtaagaatttgtgcctggtgac

SEQ ID NO: 47706 - DNA, 71 bp, chicken (Gallus Gallus)
  misc_feature (36): n=c or t
taacaaggtagtagttgaacttttcaccttcagaanataagatgaaggattaaagagcaaggaaataagtt

SEQ ID NO: 47707 - DNA, 71 bp, chicken (Gallus Gallus)
  misc_feature (36): n=a or g
tagtgaagacctgtaaacaagtataatttctattcnttagtttagtagaagtatttagatcatttttctgt

SEQ ID NO: 47708 - DNA, 71 bp, chicken (Gallus Gallus)
  misc_feature (36): n=a or c
ttctggaatgagtgctcttacttagacatttcatantcagcctttcaactcaaaggaatggatagccctaa

SEQ ID NO: 47709 - DNA, 71 bp, chicken (Gallus Gallus)
  misc_feature (36): n=g or t
accaaggtgctcaatagccccattgtgagtcagccnagtgcagtgtcaagggattttctccttgcaaagca

SEQ ID NO: 47710 - DNA, 71 bp, chicken (Gallus Gallus)
  misc_feature (36): n=c or t
gtaaatgtgaacacttggtttatcatcacttgcaangatccaagtaaccctacattatattcagtgtgcaa

SEQ ID NO: 47711 - DNA, 71 bp, chicken (Gallus Gallus)
  misc_feature (36): n=g or t
cacgtcaaagacctccttgtagtctggccatttcgntttcctttggggaaatggggaccatacctgagctg

SEQ ID NO: 47712 - DNA, 71 bp, chicken (Gallus Gallus)
  misc_feature (36): n=a or g
gcaactcctctatgacattaggagaattaaaacttnataaacagagtttaagaatgatttgggagagccat

SEQ ID NO: 47713 - DNA, 71 bp, chicken (Gallus Gallus)
  misc_feature (36): n=a or g
tcaatcatgtatatttcatagttgaatacacagacnttttaaggcttcaagtcagttttcaaaactcttta

SEQ ID NO: 47714 - DNA, 71 bp, chicken (Gallus Gallus)
  misc_feature (36): n=a or g
cagtccccttgtgcactgctgcatgtctgctcctcnccagactttactcccacagactttgtgtcagcagg

SEQ ID NO: 47715 - DNA, 71 bp, chicken (Gallus Gallus)
  misc_feature (36): n=c or t
atcaagacatactttcagaacctcactcaaaaaggntggctggaaacctcctgatttccaagcataaatgt

SEQ ID NO: 47716 - DNA, 71 bp, chicken (Gallus Gallus)
  misc_feature (36): n=c or t
atattctgacacaagtcatgtctagtcaattctcantgcaataaccagcaaggtccagaactttgccctgt

SEQ ID NO: 47717 - DNA, 71 bp, chicken (Gallus Gallus)
  misc_feature (36): n=c or t
gaatggcctaagttgtttcaagtatattcggcttgngctgcacaggaccttgcatgcccagggataggtgg

SEQ ID NO: 47718 - DNA, 71 bp, chicken (Gallus Gallus)
  misc_feature (36): n=a or c
aaaatgagattggtgaagcctttcaccttgttcctntgctacaaaacattctgcccatcaataatacccag

SEQ ID NO: 47719 - DNA, 71 bp, chicken (Gallus Gallus)
  misc_feature (36): n=c or t
tcaattccagcctggcttagaatatctccaacctgnccagaacatttgcattccctgtgctcacaggagct

SEQ ID NO: 47720 - DNA, 71 bp, chicken (Gallus Gallus)
  misc_feature (36): n=a or c
tgggatatggccagaacaggcccagagacataaaantcacatgcagcaccccactcggctgcacctcaggg

SEQ ID NO: 47721 - DNA, 71 bp, chicken (Gallus Gallus)
  misc_feature (36): n=c or t
tttgcatgggcatgacctgtgaaaggcctaattcantgctccctaatgtctgagagggacaacacaggttt

SEQ ID NO: 47722 - DNA, 71 bp, chicken (Gallus Gallus)
  misc_feature (36): n=a or g
atggaagatagtaaggaaggcagaatatcctggggnatatcctagtaaataataagtcatgagcaccaaac

SEQ ID NO: 47723 - DNA, 71 bp, chicken (Gallus Gallus)
  misc_feature (36): n=a or g
gcacatcctggcacacaggaaataaatcagcagganactgtcagaaagatggatgataggagggaagatga

SEQ ID NO: 47724 - DNA, 71 bp, chicken (Gallus Gallus)
  misc_feature (36): n=a or g
tatctatgtcttgctcaggcaacacagaaacttccnaagtaattaccaaaatgaacaatcttttccaagaa

SEQ ID NO: 47725 - DNA, 71 bp, chicken (Gallus Gallus)
  misc_feature (36): n=c or t
ccggagccaccgcacgtcctcacatgaggggtgtcngctgccctatgcgactgagcagctcccattgtgca

SEQ ID NO: 47726 - DNA, 71 bp, chicken (Gallus Gallus)
  misc_feature (36): n=a or g
cataatgaattacttctaaaaaacatgatctgaccntgctaacaataataaacctgacacctcatgcagtt

SEQ ID NO: 47727 - DNA, 71 bp, chicken (Gallus Gallus)
  misc_feature (36): n=a or g
ccaatgtctatttagaagcactatgtactgcagacntttatccacgagtgtgcagaagctgacctattgca

SEQ ID NO: 47728 - DNA, 71 bp, chicken (Gallus Gallus)
  misc_feature (36): n=a or g
tgtccccagaagcttgcagtcaaagataggtacagnaagagcactgcaaacaaatgaatagttcaataaac

SEQ ID NO: 47729 - DNA, 71 bp, chicken (Gallus Gallus)
  misc_feature (36): n=a or g
agaagaaaataaatagataaggcaggcactgaaggnagaagaagaagcacaataaggagagttatttcatt

SEQ ID NO: 47730 - DNA, 71 bp, chicken (Gallus Gallus)
  misc_feature (36): n=c or t
ccaaatgctgaacagccctcatgatttcctcctganttttctcccatgatgtgtaaaagttagtgcaacca

SEQ ID NO: 47731 - DNA, 71 bp, chicken (Gallus Gallus)
  misc_feature (36): n=a or g
acatttactctgcagaaaagcacaaggcacaaaacncttttctcagaacatatctcaactttaggagaaga

SEQ ID NO: 47732 - DNA, 71 bp, chicken (Gallus Gallus)
  misc_feature (36): n=g or t
caagctgcaaacattaaaacacaaagccaagctttntgtataattccttcttctgagtcttttctaccaat

SEQ ID NO: 47733 - DNA, 71 bp, chicken (Gallus Gallus)
  misc_feature (36): n=a or g
gtttccctttgttttgcagaagaattgtcactccanttaatgctagaaatatccctaactcatgcctccat

SEQ ID NO: 47734 - DNA, 71 bp, chicken (Gallus Gallus)
  misc_feature (36): n=c or t
cagagaggcacagagcatccatgctcactgaaacangcagctgctccagtccctgaggatcccactacaca

SEQ ID NO: 47735 - DNA, 71 bp, chicken (Gallus Gallus)
  misc_feature (36): n=a or g
gaactttctgagtttaacatctgcaagcactgaaancaggactctcaagacccttagaaatgagctcacat

SEQ ID NO: 47736 - DNA, 71 bp, chicken (Gallus Gallus)
  misc_feature (36): n=c or t
tgtttctgcaggcctcgtcgtttattcaacagcacnctttaacagcccaaatttaaaagataattaggaat

SEQ ID NO: 47737 - DNA, 71 bp, chicken (Gallus Gallus)
  misc_feature (36): n=g or t
ggatagagtgctgtgtgggcaacctctgctttgttnttcccttctgatgccatttcatgcaaaggaaatga

SEQ ID NO: 47738 - DNA, 71 bp, chicken (Gallus Gallus)
  misc_feature (36): n=a or g
gctcagcatctgggttgagcccaagaaatcattacnggttgattttattgtttgctgtctctattgttgta

SEQ ID NO: 47739 - DNA, 71 bp, chicken (Gallus Gallus)
  misc_feature (36): n=a or g
tgtcagagaaaggcaaaccacaaacaaaggagttcngtgaactgaactgctattttgactaaatgtgaaag

SEQ ID NO: 47740 - DNA, 71 bp, chicken (Gallus Gallus)
  misc_feature (36): n=c or t
ctgcaacatattcctttcatgctacctcatatcatncaaaattactagaaaagagaggcctacagtgcagg

SEQ ID NO: 47741 - DNA, 71 bp, chicken (Gallus Gallus)
  misc_feature (36): n=g or t
ttttttcacaggcattaggtagttaggttctccttnggttttacttttttgtaagagattgctgccttgct

SEQ ID NO: 47742 - DNA, 71 bp, chicken (Gallus Gallus)
  misc_feature (36): n=a or g
agtgccctgagcttatttcctaaacagaaggcagcntgggacaatttgaggaacagggattcaactacctt

SEQ ID NO: 47743 - DNA, 71 bp, chicken (Gallus Gallus)
  misc_feature (36): n=c or t
ctgaaggctgccagggatggtgcaaacattgtgatngccgccaagacagcagaaccccatcctaaacttcc

SEQ ID NO: 47744 - DNA, 71 bp, chicken (Gallus Gallus)
  misc_feature (36): n=a or g
tttgccctgtggtattggatgagtttccagaaaacnaatgagaaagctggaagaatatgcacactgctccc

SEQ ID NO: 47745 - DNA, 71 bp, chicken (Gallus Gallus)
  misc_feature (36): n=a or g
ttctacaaaagcactcggtgcatcgccccacccccnacatcccagcaggctgatgcacagtgctggaacca

SEQ ID NO: 47746 - DNA, 71 bp, chicken (Gallus Gallus)
  misc_feature (36): n=a or g
ggactcctgaatcaaacacacctctaaatggacacnacttccagagttgtgcagaccttctacagcatgga

SEQ ID NO: 47747 - DNA, 71 bp, chicken (Gallus Gallus)
  misc_feature (36): n=c or t
tgtattcagtgttatgaaaaataccacatacactancaacagtttttcaaagattaggtaacactattttt

SEQ ID NO: 47748 - DNA, 71 bp, chicken (Gallus Gallus)
  misc_feature (36): n=c or t
tagaatttctgtacatgcaaccatgaactatgccanacccaaatttcagagtattagaaatgtctcatcag

SEQ ID NO: 47749 - DNA, 71 bp, chicken (Gallus Gallus)
  misc_feature (36): n=a or g
tttatacataaggtcctataccattattatggggtnaaatgcatcaaactgatcaataattgtaaacagca

SEQ ID NO: 47750 - DNA, 71 bp, chicken (Gallus Gallus)
  misc_feature (36): n=a or g
ttgtgtttgaactcttatactctcagatcatttacngaaaggacttctacttccaaactgttcagcaacac

SEQ ID NO: 47751 - DNA, 71 bp, chicken (Gallus Gallus)
  misc_feature (36): n=a or c
gtcagtagagcacaaaattctttgcatagatacgtntgtggatactgactgttcgagaggtcaagttagtt

SEQ ID NO: 47752 - DNA, 71 bp, chicken (Gallus Gallus)
  misc_feature (36): n=a or g
tctcgttctccttaaaccggtagattttgccctccnagtttctttgcagcgggagacatgcatctcagcag

SEQ ID NO: 47753 - DNA, 71 bp, chicken (Gallus Gallus)
  misc_feature (36): n=c or t
agaaaaaaacctacaacctgactgtgcactgacagnggagaaccgaaaggttcagtatacccttttctgat

SEQ ID NO: 47754 - DNA, 71 bp, chicken (Gallus Gallus)
  misc_feature (36): n=c or t
gtttaaagccctccaggcattgaaactgggcacttntcccacagctaaaatcttcaccaagaacgacccca

SEQ ID NO: 47755 - DNA, 71 bp, chicken (Gallus Gallus)
  misc_feature (36): n=a or g
acctgaccctgatatatatgtttatgagctcaggcnatggtagagaaatctggtcctggctctgctgctga

SEQ ID NO: 47756 - DNA, 71 bp, chicken (Gallus Gallus)
  misc_feature (36): n=c or t
atggtgctacttgtttgcaattatatgtattaatgntgcagtcacagaggcttcgctcagcctttcagagt

SEQ ID NO: 47757 - DNA, 71 bp, chicken (Gallus Gallus)
  misc_feature (36): n=g or t
cttatctgcgctcagatacacagtttgataaagccnccccaggaagtctgggctctgtgaggagcagagtg

SEQ ID NO: 47758 - DNA, 71 bp, chicken (Gallus Gallus)
  misc_feature (36): n=c or t
tagagcatgatactccctcaaactaataaacaggcnggtatcctgagtgctctttaaaatgaaatcacctg

SEQ ID NO: 47759 - DNA, 71 bp, chicken (Gallus Gallus)
  misc_feature (36): n=c or t
aggaattgttcaaaacagtatttaataacactagcnattgaaagagacagaaattctgagtctattttgtt

SEQ ID NO: 47760 - DNA, 71 bp, chicken (Gallus Gallus)
  misc_feature (36): n=c or t
gacagcacgtagatatccctgactgatgacagctantgcagaaccacatcccactgccaagaagcaaagca

SEQ ID NO: 47761 - DNA, 71 bp, chicken (Gallus Gallus)
  misc_feature (36): n=c or t
ggcctctcaaggaacatgtattcagctgattactanaaagccaatgagaacgatgccatccccatccgctg

SEQ ID NO: 47762 - DNA, 71 bp, chicken (Gallus Gallus)
  misc_feature (36): n=g or t
ctggatgttttcccttgttgcagcaacatcaaggangtctccttataggtgggaatggcacctgctcctcc

SEQ ID NO: 47763 - DNA, 71 bp, chicken (Gallus Gallus)
  misc_feature (36): n=a or g
aaaaaatagtcataaatgctctatctactaggcatngagagaggttgccccaggcctgcactttatgaaag

SEQ ID NO: 47764 - DNA, 71 bp, chicken (Gallus Gallus)
  misc_feature (36): n=c or t
tttgtttctttttcctggagcactgaagatagatgnctttaaacaatgaaaacatacttccaagtacacag

SEQ ID NO: 47765 - DNA, 71 bp, chicken (Gallus Gallus)
  misc_feature (36): n=a or g
caccttgtccacagtggcatccatggctgctgggancattcattttgtttttaaaaaaaaattccttgtcc

SEQ ID NO: 47766 - DNA, 71 bp, chicken (Gallus Gallus)
  misc_feature (36): n=a or c
ggctgtagaaatctcatggtaattctaaagaagatngtggcctagcaggtaaggtacggaggagttagggg

SEQ ID NO: 47767 - DNA, 71 bp, chicken (Gallus Gallus)
  misc_feature (36): n=a or c
tagatggcattctggaggattctataatttcaggtntttgctgctaggtaatcactattacctaccaatat

SEQ ID NO: 47768 - DNA, 71 bp, chicken (Gallus Gallus)
  misc_feature (36): n=a or c
ggaagggtagaaaaccaaattggttccattgttcanattaaaatcctgttgcttccaaaggcgtcaggctt

SEQ ID NO: 47769 - DNA, 71 bp, chicken (Gallus Gallus)
  misc_feature (36): n=a or c
aagaccctgctgtggaaaagaaggtgtagggactgngtttgggcatatttctctggataatcacaaaaaac

SEQ ID NO: 47770 - DNA, 71 bp, chicken (Gallus Gallus)
  misc_feature (36): n=c or t
gattatgctagaattcagattctaataaaccgtttnatattttggctagttatagtattgctactatgagc

SEQ ID NO: 47771 - DNA, 71 bp, chicken (Gallus Gallus)
  misc_feature (36): n=a or g
aaatgaatgtgaaaacatctaaaaggctctggggtnacctcagctgataataaggggaatcttttacagtt

SEQ ID NO: 47772 - DNA, 71 bp, chicken (Gallus Gallus)
  misc_feature (36): n=c or t
gtacagagaattttcaaaggagaatgaccagactcnccctgataaaaattagttgaatgccttaatgacta

SEQ ID NO: 47773 - DNA, 71 bp, chicken (Gallus Gallus)
  misc_feature (36): n=a or g
ccttcttattcctgcatcccctactgccctatgcantaagctaaacttctttgcaattcatatttgaaagt

SEQ ID NO: 47774 - DNA, 71 bp, chicken (Gallus Gallus)
  misc_feature (36): n=c or t
acatctttatgaatgtatggatttcagttaaagggngtgtttcaaatatacctaagtgggaacaataaata

SEQ ID NO: 47775 - DNA, 71 bp, chicken (Gallus Gallus)
  misc_feature (36): n=c or t
actccagaaaactgttgtataaatgtctttctacanacacaagagcagaatctgtgatacagctgttcacc

SEQ ID NO: 47776 - DNA, 71 bp, chicken (Gallus Gallus)
  misc_feature (36): n=c or t
ataattgggtactggcagtgagtccagtaacagcgntctttactggttactagttcctcaccagaggccaa

SEQ ID NO: 47777 - DNA, 71 bp, chicken (Gallus Gallus)
  misc_feature (36): n=a or g
tgaacccctcaggcctgaaaatacatgaggtttgantctcagctgctgttaaatgagagcatgcagaggaa

SEQ ID NO: 47778 - DNA, 71 bp, chicken (Gallus Gallus)
  misc_feature (36): n=c or t
ctctgagtagacttctacctacctgaagctaacatnctattgcagaatatatgttgatgaggactggtcat

SEQ ID NO: 47779 - DNA, 71 bp, chicken (Gallus Gallus)
  misc_feature (36): n=c or t
ttacttacctctagaaacaattgctaccagcaactnacaatgactcctgaggagtcagtactaattgacct

SEQ ID NO: 47780 - DNA, 71 bp, chicken (Gallus Gallus)
  misc_feature (36): n=a or g
gcccgtgttatcgtcgcctctgcagatggtgcagangctctccaggaacaccatctttagcgcctcattct

SEQ ID NO: 47781 - DNA, 71 bp, chicken (Gallus Gallus)
  misc_feature (36): n=a or g
atttccatagtgtggtaagcacaagcatgtgttctnatctatagaaaatacattttccttttaatccttcc

SEQ ID NO: 47782 - DNA, 71 bp, chicken (Gallus Gallus)
  misc_feature (36): n=c or t
ttccagtatactaaagctgataacctttgccagtgnattattcagtgctgaacagaatctactgaggaatc

SEQ ID NO: 47783 - DNA, 71 bp, chicken (Gallus Gallus)
  misc_feature (36): n=a or g
tagcatatttattaagaaatgaattcctgttctgtntcttcagtgtatttgtgtcttcagtgtgtgctgca

SEQ ID NO: 47784 - DNA, 71 bp, chicken (Gallus Gallus)
  misc_feature (36): n=a or g
gttccttgtcatggggatgtgagatcttcatgttcntttagttatggtggagtaattcttctgcatatttt

SEQ ID NO: 47785 - DNA, 71 bp, chicken (Gallus Gallus)
  misc_feature (36): n=a or g
gagtcatctgcaagtagacagcaggtgaacattaancataaaatacatgtgctgtcaggtattcaaatgca

SEQ ID NO: 47786 - DNA, 71 bp, chicken (Gallus Gallus)
  misc_feature (36): n=c or t
ataatggactcacactcctataggtaacttacacangaagaagtgcctttttaatattatattcaattaga

SEQ ID NO: 47787 - DNA, 71 bp, chicken (Gallus Gallus)
  misc_feature (36): n=a or c
tacccagggttttataacaaacacttcacatggccnaagtggctatttgcagtccacaataagcctctcta

SEQ ID NO: 47788 - DNA, 71 bp, chicken (Gallus Gallus)
  misc_feature (36): n=a or g
catatttataacaaagctgattgtcactcagatgantacaaccaagctacatcattttaatttgtcttcgg

SEQ ID NO: 47789 - DNA, 71 bp, chicken (Gallus Gallus)
  misc_feature (36): n=c or t
aatgtaatattccgtaaaacaactgtcttttatcantgaaccttttttgatactgaaaaagcaccagaatg

SEQ ID NO: 47790 - DNA, 71 bp, chicken (Gallus Gallus)
  misc_feature (36): n=a or g
ctaaggccacttcacactgctttgaagctctggatngaaaggaaagaacccacaggcctcatcctgtgaca

SEQ ID NO: 47791 - DNA, 71 bp, chicken (Gallus Gallus)
  misc_feature (36): n=a or g
tgaagaaccataaatctttctgttagaaggctactncatgctgtatttggtagtaattttcaaaatagaag

SEQ ID NO: 47792 - DNA, 71 bp, chicken (Gallus Gallus)
  misc_feature (36): n=a or g
gttgaaagaagcttcagcagaggatattctctgaangagctaccctgtgccagtgggaagatcttaatgag

SEQ ID NO: 47793 - DNA, 71 bp, chicken (Gallus Gallus)
  misc_feature (36): n=c or t
ttggagatagaattctcttgtactgcgtgccagccntttctcctaatactactggatcgctcctttcactt

SEQ ID NO: 47794 - DNA, 71 bp, chicken (Gallus Gallus)
  misc_feature (36): n=c or t
ggtaccttccaattctccttttcaaatacttggatnctggtactctgcctaaaatgcaatcgagatgagtg

SEQ ID NO: 47795 - DNA, 71 bp, chicken (Gallus Gallus)
  misc_feature (36): n=c or t
ccccagctttgcaaacctctccctgtctcacctacntgggctcttaaatgaacagcgagacacacctgcta

SEQ ID NO: 47796 - DNA, 71 bp, chicken (Gallus Gallus)
  misc_feature (36): n=c or t
caattgttagctgactttacataagaacagaatttncttttctctggttctctggttgcccacagttattt

SEQ ID NO: 47797 - DNA, 71 bp, chicken (Gallus Gallus)
  misc_feature (36): n=c or t
gagtatgattgtggtgcagccacatacagtatccantccaaatccctcctgccccatctgcacttgtttac

SEQ ID NO: 47798 - DNA, 71 bp, chicken (Gallus Gallus)
  misc_feature (36): n=a or g
aaggccagttatacaaagacctctgttgttgcatgnttaatgcgttttgatgagaatggattgttctcatc

SEQ ID NO: 47799 - DNA, 71 bp, chicken (Gallus Gallus)
  misc_feature (36): n=a or g
gcacttgagaaactgaagtataagaaataatgaacngtaagggaaagaaggtttagttttgagttactctc

SEQ ID NO: 47800 - DNA, 71 bp, chicken (Gallus Gallus)
  misc_feature (36): n=c or t
ttagtcatcaaacactctaatctgaattggaggtgnttttttttttttccagcttgtaggctagcagagct

SEQ ID NO: 47801 - DNA, 71 bp, chicken (Gallus Gallus)
  misc_feature (36): n=c or t
gtctatttattcttgcaattacaactattttttttnccatcatctctgttacacgcttttctcacaattgt

SEQ ID NO: 47802 - DNA, 71 bp, chicken (Gallus Gallus)
  misc_feature (36): n=a or g
tcatgaaacataactgaacaagaagctcctgtgagnaaagtgagactgaaatacaatcagtgtgttttatt

SEQ ID NO: 47803 - DNA, 71 bp, chicken (Gallus Gallus)
  misc_feature (36): n=g or t
tatatgaagaaaagtgaatgatcatattccaaaacnacatttgttgtattggccatcacggatcatgctga

SEQ ID NO: 47804 - DNA, 71 bp, chicken (Gallus Gallus)
  misc_feature (36): n=a or c
aaccagcaggttaggaacagaatctgagaagagaanactcctcttttagtagctcagtagaccaacgattg

SEQ ID NO: 47805 - DNA, 71 bp, chicken (Gallus Gallus)
  misc_feature (36): n=c or t
cacaagaagaaaaacttactttactacatctcctcngagttttatcatgcaaagcttctaagagctaattt

SEQ ID NO: 47806 - DNA, 71 bp, chicken (Gallus Gallus)
  misc_feature (36): n=a or c
tatatgggccgagaaaaacattgaaggtaagagaanacacaggaaatatttggctacagtaagccaaatta

SEQ ID NO: 47807 - DNA, 71 bp, chicken (Gallus Gallus)
  misc_feature (36): n=a or g
accttatacattgaaaacactatcatgtacttgcantataaaaaactcccctgaagctgtttatcttatac

SEQ ID NO: 47808 - DNA, 71 bp, chicken (Gallus Gallus)
  misc_feature (36): n=a or c
tatttttgtcatcattttgttttggacagcccatgntttaattagtttactacaaatttgacattcatttc

SEQ ID NO: 47809 - DNA, 71 bp, chicken (Gallus Gallus)
  misc_feature (36): n=c or t
ttctttgaagttattgcacaattacatatttgaatncacatatttctctgtataatgagaactctgctata

SEQ ID NO: 47810 - DNA, 71 bp, chicken (Gallus Gallus)
  misc_feature (36): n=c or t
tttgagcttgggatttggcacacatctagtttcaanggggctctataccattttggagaacattttttctc

SEQ ID NO: 47811 - DNA, 71 bp, chicken (Gallus Gallus)
  misc_feature (36): n=c or t
acactaagaatttggaaactctgtagtcacctgtcngtattcaaaccactctcttctatactatgaacaat

SEQ ID NO: 47812 - DNA, 71 bp, chicken (Gallus Gallus)
  misc_feature (36): n=a or g
cagcttctggcgtggctgtgtgccctcagcatgacntgagcaaggcacaagtggttggcaccaggcccaaa

SEQ ID NO: 47813 - DNA, 71 bp, chicken (Gallus Gallus)
  misc_feature (36): n=a or c
catacaactttctggttgttcctggctcatcaggancacatataacatgcaggctgtgttcttgatggatg

SEQ ID NO: 47814 - DNA, 71 bp, chicken (Gallus Gallus)
  misc_feature (36): n=a or g
acatctttaccttacccagctaaagtggaatgtacnattctcacatagttctctttctgggttaatagaag

SEQ ID NO: 47815 - DNA, 71 bp, chicken (Gallus Gallus)
  misc_feature (36): n=a or g
ctctctagactttaaaattatgaacaagagaatatncttgctaataaaatgcaacacagcattcagaagac

SEQ ID NO: 47816 - DNA, 71 bp, chicken (Gallus Gallus)
  misc_feature (36): n=g or t
ctcacagattcccagaagcaaggaacagtatttttncaagtgtgatgatgtcagagtatgtgtaaatgtag

SEQ ID NO: 47817 - DNA, 71 bp, chicken (Gallus Gallus)
  misc_feature (36): n=c or t
tgccattatgtagtgttactctgtatcattcagagntgtaagtttcagcgtttctatacatcaagacataa

SEQ ID NO: 47818 - DNA, 71 bp, chicken (Gallus Gallus)
  misc_feature (36): n=a or g
ggtaatttatgcttgactaaacaccttgaaaacatntcaacgggaaaaagagaattcagaaaaagatgagt

SEQ ID NO: 47819 - DNA, 71 bp, chicken (Gallus Gallus)
  misc_feature (36): n=a or g
tagaggaatgccattaaacagcatccatagaagcantagctgttggagctacttctttcttagaggactga

SEQ ID NO: 47820 - DNA, 71 bp, chicken (Gallus Gallus)
  misc_feature (36): n=c or t
tcttctgtctttttaaaaatgaataaaaaaaattgngtgtgcggattcaaacatatgtatgtcatcttcaa

SEQ ID NO: 47821 - DNA, 71 bp, chicken (Gallus Gallus)
  misc_feature (36): n=c or t
agtgctgcttaatttacccttcaacttttgaagatntgtatactgcaaagcccagttttaaacggtgtgcc

SEQ ID NO: 47822 - DNA, 71 bp, chicken (Gallus Gallus)
  misc_feature (36): n=c or t
aatcagaatttttgcttattgtgactatctatcctntagaagacatagtcagccattaaataatatcttaa

SEQ ID NO: 47823 - DNA, 71 bp, chicken (Gallus Gallus)
  misc_feature (36): n=a or g
tttatattaaaggtacaccctgtgaaatgtgctgtntattttacatgaagtatccagctacagtaaagaac

SEQ ID NO: 47824 - DNA, 71 bp, chicken (Gallus Gallus)
  misc_feature (36): n=g or t
taaacagaaatggctaagaggcaattaaaactatgntttttttggacctgtttctattttcaagaagcagt

SEQ ID NO: 47825 - DNA, 71 bp, chicken (Gallus Gallus)
  misc_feature (36): n=a or c
agccctttacaggcattatcacccaaaacagtgttnatttcttctacctgttgataataaaaaagataaaa

SEQ ID NO: 47826 - DNA, 71 bp, chicken (Gallus Gallus)
  misc_feature (36): n=c or t
cctccttgatacaccaactggaatccagttcagcangtagatcagtgcattcaaggcatcttttggttccc

SEQ ID NO: 47827 - DNA, 71 bp, chicken (Gallus Gallus)
  misc_feature (36): n=c or t
attattcatctctcacttatgagaaccagaaagccnattttcaactacagagataagattggaccacatga

SEQ ID NO: 47828 - DNA, 71 bp, chicken (Gallus Gallus)
  misc_feature (36): n=c or t
ctaaagaaaatgaagagaaccaacagccagagaacngggaaaaaatcatcactgtacatataagatgctcc

SEQ ID NO: 47829 - DNA, 71 bp, chicken (Gallus Gallus)
  misc_feature (36): n=c or t
attcttctcaaattcttcagccctttcagtgaaaanagttccacacacacatgaacacacaaacgcactat

SEQ ID NO: 47830 - DNA, 71 bp, chicken (Gallus Gallus)
  misc_feature (36): n=c or t
ttgtttacatcctgatgtctgcaaaaaatgtcttangcttggctatttggtttctcactatatttattcaa

SEQ ID NO: 47831 - DNA, 71 bp, chicken (Gallus Gallus)
  misc_feature (36): n=g or t
gttttctcagcctgaaagctacagatgagtctgctnactaaacctcatcttggagaatatgagatttgcat

SEQ ID NO: 47832 - DNA, 71 bp, chicken (Gallus Gallus)
  misc_feature (36): n=c or t
caattccttggggacaaagtgaaagaaaacagtcangccagggctatgagtgtcacctcagagacatcagt

SEQ ID NO: 47833 - DNA, 71 bp, chicken (Gallus Gallus)
  misc_feature (36): n=g or t
gattaaagattttgcaactaaatgtaaatataaaanagtgcagtttaatgattaataattcatttacttaa

SEQ ID NO: 47834 - DNA, 71 bp, chicken (Gallus Gallus)
  misc_feature (36): n=a or g
tgctggctaattccagtcacatttaaaagaggaggntttcttagagaaatgtaaatgcttcaagctcctga

SEQ ID NO: 47835 - DNA, 71 bp, chicken (Gallus Gallus)
  misc_feature (36): n=a or g
tggtaaaaatttccctttactgggaaagatagctcntcataactttaatagactaccacaacagttttaaa

SEQ ID NO: 47836 - DNA, 71 bp, chicken (Gallus Gallus)
  misc_feature (36): n=a or g
ctttgtttcatcaacaaaatagaaatatggtgtggnaaaaggtaataagttacaattcctgctgaaatgaa

SEQ ID NO: 47837 - DNA, 71 bp, chicken (Gallus Gallus)
  misc_feature (36): n=c or t
ttctattacctgcaagaaagtactcctttacaacanatagcctctagtgctcatagttcttagttttctcc

SEQ ID NO: 47838 - DNA, 71 bp, chicken (Gallus Gallus)
  misc_feature (36): n=a or g
agtatttttaatatttcaaggacatgattgcttaanttaccttccacaaaagtgtcaactagggctttaag

SEQ ID NO: 47839 - DNA, 71 bp, chicken (Gallus Gallus)
  misc_feature (36): n=a or g
ctaacaagaagaaagtcctgaatggttaagttcacntggggaacttgcactgacaacactgtctaaagaat

SEQ ID NO: 47840 - DNA, 71 bp, chicken (Gallus Gallus)
  misc_feature (36): n=a or g
tccttgccgctgttcagctgtgggcagcgtgagcanagacttgtattgattgttctgctcgtaatttagca

SEQ ID NO: 47841 - DNA, 71 bp, chicken (Gallus Gallus)
  misc_feature (36): n=c or t
tgtacaaatacctcacagtaggcagcttctgtcctnggaatctcaacacctgaactacagacttacaagaa

SEQ ID NO: 47842 - DNA, 71 bp, chicken (Gallus Gallus)
  misc_feature (36): n=c or t
gctcaggtctgaatgactgcacatcacctaataganggcataggtaagacccctctctgtcttcatgagaa

SEQ ID NO: 47843 - DNA, 71 bp, chicken (Gallus Gallus)
  misc_feature (36): n=a or g
acctcacgtaactggtactgaagaagagcacctcantttacggtactagaatctgtcagttatgggtgaga

SEQ ID NO: 47844 - DNA, 71 bp, chicken (Gallus Gallus)
  misc_feature (36): n=a or g
tctttgattcagtgaatgccctgcaaataaattacntaagaaaactgtgattacataaagtgcattgcaca

SEQ ID NO: 47845 - DNA, 71 bp, chicken (Gallus Gallus)
  misc_feature (36): n=c or t
ccatcatccttgcaggtctaagtcttccaccattgnattttgtgagtttaaccactctagcatcatgtatg

SEQ ID NO: 47846 - DNA, 71 bp, chicken (Gallus Gallus)
  misc_feature (36): n=a or g
ttaaaatacattttctcttcctcgctgtttctgtcnaaattaagaagtattagagtgatattcatgaggac

SEQ ID NO: 47847 - DNA, 71 bp, chicken (Gallus Gallus)
  misc_feature (36): n=a or g
tcaggcaggggattcacattcttctttgcatgctgnattcttctgcatgaatcctcatgccattatgctct

SEQ ID NO: 47848 - DNA, 71 bp, chicken (Gallus Gallus)
  misc_feature (36): n=c or t
atactctaccacagaagaaaagtttgccttttgttnttcaatgatatctttgctaaactgaacaaactgca

SEQ ID NO: 47849 - DNA, 71 bp, chicken (Gallus Gallus)
  misc_feature (36): n=a or g
tgtttgtatggccagtaaaacactgccaactatggnatcagtgaatatttgagctgttcacaacaggggtc

SEQ ID NO: 47850 - DNA, 71 bp, chicken (Gallus Gallus)
  misc_feature (36): n=c or t
tactctccagccaatgccagcaccagattacaaccngtcagagcaagagacgagcactaccttgaggcctc

SEQ ID NO: 47851 - DNA, 71 bp, chicken (Gallus Gallus)
  misc_feature (36): n=a or g
taatctctgttcaacattcctaattcattattaaantaccacaagttcaactattattgaaaaacacttaa

SEQ ID NO: 47852 - DNA, 71 bp, chicken (Gallus Gallus)
  misc_feature (36): n=c or t
atggacaattactatttcactagcatatacacttanaagaaagtagagaattaattctgtgaatacattat

SEQ ID NO: 47853 - DNA, 71 bp, chicken (Gallus Gallus)
  misc_feature (36): n=a or c
tttatatcaaacgtatgtactgagtgaaagaaaganacagtatgtcttgacgatggtttctaaattaataa

SEQ ID NO: 47854 - DNA, 71 bp, chicken (Gallus Gallus)
  misc_feature (36): n=a or g
agatcaggcagtcttaacaatttcactgcaaacaangccaatttcaagaactaaaaaatggaggctgaaga

SEQ ID NO: 47855 - DNA, 71 bp, chicken (Gallus Gallus)
  misc_feature (36): n=a or g
ttctgctgtcagtgaacactatttcttatttctctnttattagggtttattaaaccattcatcaattctct

SEQ ID NO: 47856 - DNA, 71 bp, chicken (Gallus Gallus)
  misc_feature (36): n=a or g
tcagcatcaagatagttcaacatgcaatcatgttcnatgtaagaaaaagcaccaatgatttgcacaagatc

SEQ ID NO: 47857 - DNA, 71 bp, chicken (Gallus Gallus)
  misc_feature (36): n=a or g
caagtaatacatttcttaagaatgtgatccataacngccttcttatgagtctcccttttcattgtcatggg

SEQ ID NO: 47858 - DNA, 71 bp, chicken (Gallus Gallus)
  misc_feature (36): n=a or g
ttgataaagcttttcagactaacataagggcataangtaggtaaccaagtatacttgcctggtaatcacag

SEQ ID NO: 47859 - DNA, 71 bp, chicken (Gallus Gallus)
  misc_feature (36): n=a or g
tctctctcttctacttagttccttactcttactccnaaggacatcatctcacctgttgttccctctagttt

SEQ ID NO: 47860 - DNA, 71 bp, chicken (Gallus Gallus)
  misc_feature (36): n=a or c
tacgaacttgaggcagaaatgaaagtgtggtcattncagcaaagctggtgcagaattaaaatcacacacac

SEQ ID NO: 47861 - DNA, 71 bp, chicken (Gallus Gallus)
  misc_feature (36): n=c or t
aaggagactgtggcttcaaaattggagtgaatgtangttcaacagaagtacctgctatttagaaaatggac

SEQ ID NO: 47862 - DNA, 71 bp, chicken (Gallus Gallus)
  misc_feature (36): n=a or g
tctgggccaatcccaccaaaaaactttgtgaactgnggatgaaatttgaactgaactttttttgcgcaatg

SEQ ID NO: 47863 - DNA, 71 bp, chicken (Gallus Gallus)
  misc_feature (36): n=c or t
tcagactcccaagcactctcttctgtattgatttanctaaatagcactgcctggctacacagaatgaagtg

SEQ ID NO: 47864 - DNA, 71 bp, chicken (Gallus Gallus)
  misc_feature (36): n=c or t
agtggacagttttccagacaaagtgtttgatctganctcatttctaggtttgataatgggcctattggttt

SEQ ID NO: 47865 - DNA, 71 bp, chicken (Gallus Gallus)
  misc_feature (36): n=c or t
tgctacttgaaagcccacccacctctgttcctgtgnggaaaagcgctttgcttgttaattacactgttttt

SEQ ID NO: 47866 - DNA, 71 bp, chicken (Gallus Gallus)
  misc_feature (36): n=c or t
gcttaattatctgcacgttatgtgctctttcccccngtgatgactcattctgggtcacaaaaatcttgggt

SEQ ID NO: 47867 - DNA, 71 bp, chicken (Gallus Gallus)
  misc_feature (36): n=c or t
aaaggcctcacaaaaaataagtagagaaaaccaatngcacccatagtctggaacttcacattatttccaaa

SEQ ID NO: 47868 - DNA, 71 bp, chicken (Gallus Gallus)
  misc_feature (36): n=a or g
aacaagaggaatttaatgtgaggatatgaaaggctntaaggaccaacatttagtttattgagaatggcttt

SEQ ID NO: 47869 - DNA, 71 bp, chicken (Gallus Gallus)
  misc_feature (36): n=c or t
ttttgtttgacattgtgacttgactctgaagcaganacacaaatcaaataaaatccctggctttgctgtta

SEQ ID NO: 47870 - DNA, 71 bp, chicken (Gallus Gallus)
  misc_feature (36): n=a or c
aatagttcgctattaagttaatgataacagttgagncatcattcaaactgtcagctatgtacaaactttta

SEQ ID NO: 47871 - DNA, 71 bp, chicken (Gallus Gallus)
  misc_feature (36): n=a or g
cgttgtcatcttctctctagctgcccagtcctatgntgtactgcatctgattcagagctgaggaatgttcc

SEQ ID NO: 47872 - DNA, 71 bp, chicken (Gallus Gallus)
  misc_feature (36): n=c or t
atgtaatatattaggagatttttcgaagacacttgnagaaattgtactctgaaatttctaataagtttttg

SEQ ID NO: 47873 - DNA, 71 bp, chicken (Gallus Gallus)
  misc_feature (36): n=c or t
gtaaagagcatccaataacaatccttaatttccacncccaaatttgcttcctcttccatgacatgaaaaat

SEQ ID NO: 47874 - DNA, 71 bp, chicken (Gallus Gallus)
  misc_feature (36): n=c or t
ccttgtggcaaaaagtgtacaatacagatgaggtgntgggatataacaaagtgtgggaagttctgctactg

SEQ ID NO: 47875 - DNA, 71 bp, chicken (Gallus Gallus)
  misc_feature (36): n=c or t
ggccggtgtgagtagcccacagttgttaaccagtcnaggcaaaaacagataaggctgtgttgtgttttcag

SEQ ID NO: 47876 - DNA, 71 bp, chicken (Gallus Gallus)
  misc_feature (36): n=c or t
acgctcctttgattggtgtagactcactgatttttntaccttatccatcaacgtatgtaaagttttcacgt

SEQ ID NO: 47877 - DNA, 71 bp, chicken (Gallus Gallus)
  misc_feature (36): n=c or t
gaatctttttaaattctggtgactgcctgatcatanggagatgtgaatagatgggtggatgtccaagggag

SEQ ID NO: 47878 - DNA, 71 bp, chicken (Gallus Gallus)
  misc_feature (36): n=c or t
aagcaaaatatccttattataacacaaagttattgngtttgtttcacttattgatgtgtctgaagtattct

SEQ ID NO: 47879 - DNA, 71 bp, chicken (Gallus Gallus)
  misc_feature (36): n=c or t
caaacacttctgaaatagaaacaaatccgagagagngagccctcttcaaaatgcttactgtatacgttaat

SEQ ID NO: 47880 - DNA, 71 bp, chicken (Gallus Gallus)
  misc_feature (36): n=a or c
tcctgatgatgtattgctatgccactgcagaaactnttccaaaatttgaggcaaaatggtaagtgaagtga

SEQ ID NO: 47881 - DNA, 71 bp, chicken (Gallus Gallus)
  misc_feature (36): n=a or g
aaactcggagatcctacccagaaactcccactaacntcaatgggatctactgaagcaaaagtaatagagaa

SEQ ID NO: 47882 - DNA, 71 bp, chicken (Gallus Gallus)
  misc_feature (36): n=a or g
taagctctgtgcaagaagtcacactgcccgcagacntgggaatggcagcccctcagtggctgtgcccatgg

SEQ ID NO: 47883 - DNA, 71 bp, chicken (Gallus Gallus)
  misc_feature (36): n=c or t
tcctacttgctccccttggtttcagatttactttcntgatgctctcccaggtactgctaccctgccagttg

SEQ ID NO: 47884 - DNA, 71 bp, chicken (Gallus Gallus)
  misc_feature (36): n=a or c
agagagccttgaaaaaaaccatataaatgtttaagnttggacttccttttggttctgttacttgtgataag

SEQ ID NO: 47885 - DNA, 71 bp, chicken (Gallus Gallus)
  misc_feature (36): n=c or t
tcctggaagatctgcacatcttgagagagaagtgtntggttacagcctgggaatttgaaatcatcatcttg

SEQ ID NO: 47886 - DNA, 71 bp, chicken (Gallus Gallus)
  misc_feature (36): n=a or g
cttaggatcccattgaggctgatctaccaattaganttcctttatcctataacttaggtgccatcttactg

SEQ ID NO: 47887 - DNA, 71 bp, chicken (Gallus Gallus)
  misc_feature (36): n=a or c
gaaaaggagtagtgtcttttaagcaacacaatatcncgtgccagtggggtttcctgtgcagttttctcaga

SEQ ID NO: 47888 - DNA, 71 bp, chicken (Gallus Gallus)
  misc_feature (36): n=g or t
tatttccatgtttatcccatgtgatcccaacagctnaagtcagcaattaagggtttataggcaagatatct

SEQ ID NO: 47889 - DNA, 71 bp, chicken (Gallus Gallus)
  misc_feature (36): n=a or g
gtaatttcttaaaagagaaggaactgcaatgtcgtntttgtacagccataggaaccattggaaagaaacac

SEQ ID NO: 47890 - DNA, 71 bp, chicken (Gallus Gallus)
  misc_feature (36): n=c or t
aaagtgctttgtgagacaacagcaaaacagttgcanggtgcagctgccaagatggtgagatggaaactaac

SEQ ID NO: 47891 - DNA, 71 bp, chicken (Gallus Gallus)
  misc_feature (36): n=a or g
taaacataggtaactgacttgtattttgatccccantaacctgcttaattagtacagacagaatagaatcc

SEQ ID NO: 47892 - DNA, 71 bp, chicken (Gallus Gallus)
  misc_feature (36): n=g or t
tttcgcacgtacaactgcttcaatgttagaattcantttggctctctgaatactgtgtgctggctttgcaa

SEQ ID NO: 47893 - DNA, 71 bp, chicken (Gallus Gallus)
  misc_feature (36): n=c or t
tccagaaggagcactggggcagaaaagccttgctgngggccaggcggcagacacagacccgccacctgctg

SEQ ID NO: 47894 - DNA, 71 bp, chicken (Gallus Gallus)
  misc_feature (36): n=a or g
taattttgtatcacagctttacatctaggccagatnacagagcacccgtcctctgacatcatgtagctcag

SEQ ID NO: 47895 - DNA, 71 bp, chicken (Gallus Gallus)
  misc_feature (36): n=g or t
catagggaatagaaacctctaagagttaaatggaanacccataaataacattttaaagaagcaggcaatag

SEQ ID NO: 47896 - DNA, 71 bp, chicken (Gallus Gallus)
  misc_feature (36): n=c or t
tattgcaggccagagtttaataaaagtttgctctcngcatgctcacagctgaattgggcatgagaagggca

SEQ ID NO: 47897 - DNA, 71 bp, chicken (Gallus Gallus)
  misc_feature (36): n=g or t
aggcctgatacaataacatgggaacaatcacaacanaacagaagtaatcagggagattgtttttaagacta

SEQ ID NO: 47898 - DNA, 71 bp, chicken (Gallus Gallus)
  misc_feature (36): n=a or g
ttagcaatttaagctgaagagtatttctggcttaanaatatgtttcacccatgctgattgtgttgtttttt

SEQ ID NO: 47899 - DNA, 71 bp, chicken (Gallus Gallus)
  misc_feature (36): n=a or g
ggcctctacaggcccctccctgtacagagggacccntgaaaagtagtgcagcatacttggaaagtgggaat

SEQ ID NO: 47900 - DNA, 71 bp, chicken (Gallus Gallus)
  misc_feature (36): n=a or g
ctggcttgtgatgaatttgtatctccgcagcttctnatattttggattgtgtgttctagtgcaggcaattc

SEQ ID NO: 47901 - DNA, 71 bp, chicken (Gallus Gallus)
  misc_feature (36): n=a or g
acaaaacatctatacggggtgacttcaggaactccnttggcacaaatgcgtaaagaaaggtgagaagatgg

SEQ ID NO: 47902 - DNA, 71 bp, chicken (Gallus Gallus)
  misc_feature (36): n=g or t
gggagtgtttggacttctcaagcattttatcgcttntaagaatctgccgctttactctacgtgctgctggt

SEQ ID NO: 47903 - DNA, 71 bp, chicken (Gallus Gallus)
  misc_feature (36): n=c or t
ggggatcttctgggtccccagtcatcagggatgatnttcagggtgcttggctcgtctctgtggattctgtg

SEQ ID NO: 47904 - DNA, 71 bp, chicken (Gallus Gallus)
  misc_feature (36): n=a or g
gaacagcctggaatcagccggtggctgcaagagacncaaagttcaaacgcagagtacagagctacaaataa

SEQ ID NO: 47905 - DNA, 71 bp, chicken (Gallus Gallus)
  misc_feature (36): n=c or t
aagaatgaatttgcctggtctgggttgtgccctccngcgtgtttgctttctgcaaatatccatcctgcggg

SEQ ID NO: 47906 - DNA, 71 bp, chicken (Gallus Gallus)
  misc_feature (36): n=c or t
agctggacatggtggatctgcttctgagccctcccntgcaccataccactcatggcaaatggggccgtttt

SEQ ID NO: 47907 - DNA, 71 bp, chicken (Gallus Gallus)
  misc_feature (36): n=a or g
agcttttctgaaaggttagaacttatcaattctgcntttacagagtgaagcctttgcatttttcatcagta

SEQ ID NO: 47908 - DNA, 71 bp, chicken (Gallus Gallus)
  misc_feature (36): n=a or g
caggcataccacggtcaggggacatctaaggccagnagaatctctgactactttttcatcctgcagtctcc

SEQ ID NO: 47909 - DNA, 71 bp, chicken (Gallus Gallus)
  misc_feature (36): n=a or g
ctgaacaatcccactcccagtgctctccagactggnggtgatggccagaaaactactcagcaaaatccaga

SEQ ID NO: 47910 - DNA, 71 bp, chicken (Gallus Gallus)
  misc_feature (36): n=a or c
tccaaaatgggatgatcaacctccacactgctcagngggagcagcccaatgtctctgctgaggctttgccc

SEQ ID NO: 47911 - DNA, 71 bp, chicken (Gallus Gallus)
  misc_feature (36): n=c or t
tgttaagcataccattggaaatctggttagcaattngtttatatttttttagtttgcaattggtagtatgc

SEQ ID NO: 47912 - DNA, 71 bp, chicken (Gallus Gallus)
  misc_feature (36): n=c or t
aacaaaagaacattaaggcttttattcaaacaaaangaagtgaaaactcagtcagaagaagaaaagcctat

SEQ ID NO: 47913 - DNA, 71 bp, chicken (Gallus Gallus)
  misc_feature (36): n=c or t
ttaattaagacacacagcaacttgtggcccaaggtnacagacagacagatgctcttctattccagattatc

SEQ ID NO: 47914 - DNA, 71 bp, chicken (Gallus Gallus)
  misc_feature (36): n=c or t
gcagctgcgcacttcccacttctgctagtaaataantcaaagtttgctaatgacaagtcttggggctctgt

SEQ ID NO: 47915 - DNA, 71 bp, chicken (Gallus Gallus)
  misc_feature (36): n=c or t
ggagagagttgtgaatctgattttgatatgggaaangggcataggaaagtgagaagagtgaatgactgaaa

SEQ ID NO: 47916 - DNA, 71 bp, chicken (Gallus Gallus)
  misc_feature (36): n=c or t
ccaatgcctacagcagacctcctcagagcacctgtnctctacccctctgcagcatcccacatgctgtcttg

SEQ ID NO: 47917 - DNA, 71 bp, chicken (Gallus Gallus)
  misc_feature (36): n=a or c
cccagcagcattatacctgctcactcaggataaagncagtgctttcttgaaatggagatgcatatggcctg

SEQ ID NO: 47918 - DNA, 71 bp, chicken (Gallus Gallus)
  misc_feature (36): n=c or t
caggagctctgccagcacattgcggctgagcattanccactgtgccatttctgtcctccgggagggcactc

SEQ ID NO: 47919 - DNA, 71 bp, chicken (Gallus Gallus)
  misc_feature (36): n=c or t
aaaagcattgcgcagccagagccctgggactgcagngtagtcagaggagatgcagctacgatggtgtctgc

SEQ ID NO: 47920 - DNA, 71 bp, chicken (Gallus Gallus)
  misc_feature (36): n=c or t
tggaaactgctgagataaagtgttcaggaattccanggaaggagacataaaaaaaatgtacaattccagta

SEQ ID NO: 47921 - DNA, 71 bp, chicken (Gallus Gallus)
  misc_feature (36): n=c or t
actgttgcagagcaaagctgctccgtgctttctganggagggcaggctggtggcaaagcagctctctgctg

SEQ ID NO: 47922 - DNA, 71 bp, chicken (Gallus Gallus)
  misc_feature (36): n=c or t
gcatccttttacaaatgttgtccgtaatgtcaatgnactgacctaggaggagctctttggttatcgctaca

SEQ ID NO: 47923 - DNA, 71 bp, chicken (Gallus Gallus)
  misc_feature (36): n=a or c
ataatgacactgttgctagtgatgacaggttatacntgtaaatgttggaataaaatagttacagcactgat

SEQ ID NO: 47924 - DNA, 71 bp, chicken (Gallus Gallus)
  misc_feature (36): n=c or t
aacattattgtgtttttccaggagatgagataattnagactctgaaatgctgtatgtgaagcatattcagt

SEQ ID NO: 47925 - DNA, 71 bp, chicken (Gallus Gallus)
  misc_feature (36): n=c or t
ccaccccagaaaaacctccagtctggtttggaggangcgtgggggcacatggatatcagggttaacactct

SEQ ID NO: 47926 - DNA, 71 bp, chicken (Gallus Gallus)
  misc_feature (36): n=a or c
atcatgaatagtgtgatagtacatctattttccagngccacaaacaatgacagttttatacattcatgcac

SEQ ID NO: 47927 - DNA, 71 bp, chicken (Gallus Gallus)
  misc_feature (36): n=a or g
tacagataacaagtaatgttctaaactaataaaatngatgcagattgctagatttcatgtgcatttgtcca

SEQ ID NO: 47928 - DNA, 71 bp, chicken (Gallus Gallus)
  misc_feature (36): n=a or g
aggtatgagctattttcttggtagtgaatctgtggnaacaatgctgttcaaaaaccaggaaactaatagaa

SEQ ID NO: 47929 - DNA, 71 bp, chicken (Gallus Gallus)
  misc_feature (36): n=a or g
cgcagcactggcagcaggaccctgagctgctctacnccgtactgcagtaatccctgccaatgcaattagga

SEQ ID NO: 47930 - DNA, 71 bp, chicken (Gallus Gallus)
  misc_feature (36): n=a or c
atggttatgtccaaaagaggatttgaaatctgaaanctgagaaagtatttagttttttgccagattatagg

SEQ ID NO: 47931 - DNA, 71 bp, chicken (Gallus Gallus)
  misc_feature (36): n=g or t
ggaaggagctggaggctgtgcaatggaagagagctnccaaatcaccacagatcgtaggcgctgtttattgt

SEQ ID NO: 47932 - DNA, 71 bp, chicken (Gallus Gallus)
  misc_feature (36): n=c or t
accacatgtggcactattactgtcactttttgtccnaaagtcagcttcctagcctcctgtgttacgagttc

SEQ ID NO: 47933 - DNA, 71 bp, chicken (Gallus Gallus)
  misc_feature (36): n=a or g
aagttttccatctcaaggggaggcataaccgaactntattatatgtccaaaatatcatccttcaacaagat

SEQ ID NO: 47934 - DNA, 71 bp, chicken (Gallus Gallus)
  misc_feature (36): n=c or t
tgttgtaaataaggaaccactcttcgcctttccctngctcaatattgtaatggatcagagaaagaaaacaa

SEQ ID NO: 47935 - DNA, 71 bp, chicken (Gallus Gallus)
  misc_feature (36): n=a or g
cctgtgtgatgttactgggtcagcagtaaatatcantgcctgctctttcagcaagccaaggtaacagctca

SEQ ID NO: 47936 - DNA, 71 bp, chicken (Gallus Gallus)
  misc_feature (36): n=a or g
gcaatctgctcagaggcctttgtgttggtgatgcanccccgtcaactgcatcaagaccctctgtgtttccc

SEQ ID NO: 47937 - DNA, 71 bp, chicken (Gallus Gallus)
  misc_feature (36): n=c or t
aaccaccccacaggggaaaccagagactactttttnggaccaaggctgctcttctccagtgctgattgact

SEQ ID NO: 47938 - DNA, 71 bp, chicken (Gallus Gallus)
  misc_feature (36): n=a or g
gtcagcaggactggttagcagtttagcttgaaaccnggccaaggtggagagagcttccctcctgccatccc

SEQ ID NO: 47939 - DNA, 71 bp, chicken (Gallus Gallus)
  misc_feature (36): n=a or g
tgttagctgttcaccttttcaagttcaaacgaacancgagtgatacctgactcacccagaatgaaaacaaa

SEQ ID NO: 47940 - DNA, 71 bp, chicken (Gallus Gallus)
  misc_feature (36): n=c or t
ggcaagtctgtgagataaataaccatagaatgaacngtctgtgacaaaagtcttagtacagttacaacact

SEQ ID NO: 47941 - DNA, 71 bp, chicken (Gallus Gallus)
  misc_feature (36): n=c or t
tgactgaaggagtaggtgcaagagagattaaagacnacaggtgcatttctgaattgaggtcaggagaggaa

SEQ ID NO: 47942 - DNA, 71 bp, chicken (Gallus Gallus)
  misc_feature (36): n=c or t
tccttgcttgcattgctacgaattaggagtaactcnaagaagtcaaagtatttacatcatagtgaagctga

SEQ ID NO: 47943 - DNA, 71 bp, chicken (Gallus Gallus)
  misc_feature (36): n=a or g
gtaccctacatgtttcttacggggttcacacgcacntatcagcacttcaagggctgcagggaaaatgcatt

SEQ ID NO: 47944 - DNA, 71 bp, chicken (Gallus Gallus)
  misc_feature (36): n=a or c
gtttaccctgtccttattttccaagagaaccattanacgaacaatccctagactggactgctctttttcaa

SEQ ID NO: 47945 - DNA, 71 bp, chicken (Gallus Gallus)
  misc_feature (36): n=c or t
aaaagtatactgtccccaaaagcgaggctacaaccngggactgagaaactacggcatgagctcttctcctt

SEQ ID NO: 47946 - DNA, 71 bp, chicken (Gallus Gallus)
  misc_feature (36): n=c or t
cctggcaacacgttaggaaaacattagaaacacttnagtaagcaaataatttaattacagccctctccgag

SEQ ID NO: 47947 - DNA, 71 bp, chicken (Gallus Gallus)
  misc_feature (36): n=c or t
gcttgctcatgcaaccttaaggcaaaacagaactantgaaagacttcctactttggctgcttttcatgcca

SEQ ID NO: 47948 - DNA, 71 bp, chicken (Gallus Gallus)
  misc_feature (36): n=c or t
taagaaaattcaatttccaggcagatatgcataatnacagcaaaagagatcttttcatgattggatgggag

SEQ ID NO: 47949 - DNA, 71 bp, chicken (Gallus Gallus)
  misc_feature (36): n=a or g
aaagaaggagcagactggtggaaggagtcataggcnatgagacaactggccaaagccattcaagggtccac

SEQ ID NO: 47950 - DNA, 71 bp, chicken (Gallus Gallus)
  misc_feature (36): n=g or t
gatgaatcctgcctgcagccttgctttgttcatctncagccactatggaaggagccaagagcaccacacca

SEQ ID NO: 47951 - DNA, 71 bp, chicken (Gallus Gallus)
  misc_feature (36): n=a or g
gtttcaagtagtcttcattgggaagcgagcacgaanaacactggttctgactacaccacgctctgcttttt

SEQ ID NO: 47952 - DNA, 71 bp, chicken (Gallus Gallus)
  misc_feature (36): n=a or g
aataacaggagaaaactgcttgtgaaggcaagaacnggtggcctcagataggactgacatctggatttgga

SEQ ID NO: 47953 - DNA, 71 bp, chicken (Gallus Gallus)
  misc_feature (36): n=a or g
gcagctcagcttgctttgctgtatttactccacctntttctactagtgttcatggacactgttctagttat

SEQ ID NO: 47954 - DNA, 71 bp, chicken (Gallus Gallus)
  misc_feature (36): n=a or g
ctaccactaatttctgtaactttggcctctaaaggnacttacaaatcaatgccacactgaaagcaatagac

SEQ ID NO: 47955 - DNA, 71 bp, chicken (Gallus Gallus)
  misc_feature (36): n=c or t
ccgcttcccttttggtaccagagcttctaagtcagnggatggccacagcccttcccctacttcagagagca

SEQ ID NO: 47956 - DNA, 71 bp, chicken (Gallus Gallus)
  misc_feature (36): n=a or g
ccagagcttcatctagagaagtcttccagtcccccntgacaggtgctgcatgacagcttggcattcccaag

SEQ ID NO: 47957 - DNA, 71 bp, chicken (Gallus Gallus)
  misc_feature (36): n=c or t
gttctttggagcaacatttagctttagaaaagaatngggaaagtagtaaatctcatattatttgactttaa

SEQ ID NO: 47958 - DNA, 71 bp, chicken (Gallus Gallus)
  misc_feature (36): n=c or t
tgccaatttggagaagcgcatcacttttcttaacangtgagctattcacatgttcctttctgggagcagtg

SEQ ID NO: 47959 - DNA, 71 bp, chicken (Gallus Gallus)
  misc_feature (36): n=a or g
ctgcagttgtcctaaagttaagcatctatgtatgcntttgtgtaatcatcacagtgatcacacaaatcaca

SEQ ID NO: 47960 - DNA, 71 bp, chicken (Gallus Gallus)
  misc_feature (36): n=g or t
gtacaaggcaaggtaagttgctgtaaacagagactngatgtttcttgtaaacgtgtagaaaaaacagcttt

SEQ ID NO: 47961 - DNA, 71 bp, chicken (Gallus Gallus)
  misc_feature (36): n=c or t
atggatgaaatagcaaagtgttttgtgatgaaaganaagactcctaacattttgtcagacttagagttcat

SEQ ID NO: 47962 - DNA, 71 bp, chicken (Gallus Gallus)
  misc_feature (36): n=g or t
atctggcagcgcattcatgcaatgcccagtgctgcnccgaagcggctttagtgctgaaacagcactactaa

SEQ ID NO: 47963 - DNA, 71 bp, chicken (Gallus Gallus)
  misc_feature (36): n=a or g
caagaccttttgtgtttctcagaattactcatgaancttctccaaagaagatctctgtcgtagatggaatt

SEQ ID NO: 47964 - DNA, 71 bp, chicken (Gallus Gallus)
  misc_feature (36): n=c or t
cgtcaagctgaattacttctgaatgagctatggtgnctgcacagcacaatagggctgatttctcaatattg

SEQ ID NO: 47965 - DNA, 71 bp, chicken (Gallus Gallus)
  misc_feature (36): n=c or t
ctcttaggacttcatgttccatggcatgaaagtagntaggtggagttggggtgctgtggaggagatcactg

SEQ ID NO: 47966 - DNA, 71 bp, chicken (Gallus Gallus)
  misc_feature (36): n=c or t
ctacaatactctgctggtccaatttgatgatagccntcttcttcgttcaggactggcacaatacttttagg

SEQ ID NO: 47967 - DNA, 71 bp, chicken (Gallus Gallus)
  misc_feature (36): n=a or g
acagtcagagtgcttgggtatttggaataggcaagnagaggcagcaagagaggtgtgtcttcagacatccc

SEQ ID NO: 47968 - DNA, 71 bp, chicken (Gallus Gallus)
  misc_feature (36): n=a or g
gagcaaagcggtgctatccaggagagccccacagcnaagtggccaagtgatgagagctctgtgaccaccag

SEQ ID NO: 47969 - DNA, 71 bp, chicken (Gallus Gallus)
  misc_feature (36): n=a or g
acaaactgtttcagcaaagccagtgggccagtgagngatttccagtaggaatagcaaaaagtgacatttat

SEQ ID NO: 47970 - DNA, 71 bp, chicken (Gallus Gallus)
  misc_feature (36): n=a or g
caacacagcaccaggagggctccagtgcaaccagcntccctggcatgccgatcccaagtgtaacggggagt

SEQ ID NO: 47971 - DNA, 71 bp, chicken (Gallus Gallus)
  misc_feature (36): n=c or t
ttcactggcctaatggtaaagcaattggagtgatangttatgtttggtaaagcaattggagtgatgcatta

SEQ ID NO: 47972 - DNA, 71 bp, chicken (Gallus Gallus)
  misc_feature (36): n=a or g
tcggtgtatcagcaaagaaagtgaaaagttacagcnatgtcctgactgccactaacagcagatagaaaaca

SEQ ID NO: 47973 - DNA, 71 bp, chicken (Gallus Gallus)
  misc_feature (36): n=a or g
gtgttgtgcacaccttcttcttgcaagtcttgaacncaaccaacagcttctgcacgagtatccatgctgca

SEQ ID NO: 47974 - DNA, 71 bp, chicken (Gallus Gallus)
  misc_feature (36): n=c or t
cagtccctagctgaattttgggaagcacagtctgtntgtacaaccttgacttaaaatgtcctttttggcaa

SEQ ID NO: 47975 - DNA, 71 bp, chicken (Gallus Gallus)
  misc_feature (36): n=c or t
tggcatcaatcaggtggcctctatttggactagttnagcttcttatctgtacgccaaagttaatgtagcag

SEQ ID NO: 47976 - DNA, 71 bp, chicken (Gallus Gallus)
  misc_feature (36): n=a or g
ttccatctgtagcagaagtgcactctccttggcatncgttcccccctttttctggaatatgcctttgaggg

SEQ ID NO: 47977 - DNA, 71 bp, chicken (Gallus Gallus)
  misc_feature (36): n=c or t
gttctgttagcctaggcagagctcttagcatccttnggtgcattcataacggtgtatgtgaaccttatctg

SEQ ID NO: 47978 - DNA, 71 bp, chicken (Gallus Gallus)
  misc_feature (36): n=a or g
actgactctggatttttatttgtgactattttgtcntagctcttcttcttacagactctcctttgtatttt

SEQ ID NO: 47979 - DNA, 71 bp, chicken (Gallus Gallus)
  misc_feature (36): n=a or g
gaatataggctgtggaggtctttgagggcaaagacntggagcttgtgtttcttgagagagagaatgatgag

SEQ ID NO: 47980 - DNA, 71 bp, chicken (Gallus Gallus)
  misc_feature (36): n=c or t
tttgaggagcagacatcagcagtaatgtgacaaacnggaatacaggtccggaatgatgtctgaggagcatt

SEQ ID NO: 47981 - DNA, 71 bp, chicken (Gallus Gallus)
  misc_feature (36): n=c or t
ctttcatcctgcctgctttgataccaccgcatcccngcatcataaaaaggcaacgaggctgatgtcagctg

SEQ ID NO: 47982 - DNA, 71 bp, chicken (Gallus Gallus)
  misc_feature (36): n=a or g
ttgaggctgccagatgatagccacagccctgcttcntggctaagccctggggaaagtgcagccaaggagtt

SEQ ID NO: 47983 - DNA, 71 bp, chicken (Gallus Gallus)
  misc_feature (36): n=c or t
gaagtgattgaccagcagatgggctacatcagtgantcttcttgcaacagctctgatggggtgctggtgaa

SEQ ID NO: 47984 - DNA, 71 bp, chicken (Gallus Gallus)
  misc_feature (36): n=c or t
cacacgttggctactggagggatgtaaagtgtttcntcaagcctcgccagaggaggggggatgtgggcatg

SEQ ID NO: 47985 - DNA, 71 bp, chicken (Gallus Gallus)
  misc_feature (36): n=a or g
gaccctcagcaaaagaacagtaggcttatcaaacancgaagaaaccagggcctctacacaaggccagactg

SEQ ID NO: 47986 - DNA, 71 bp, chicken (Gallus Gallus)
  misc_feature (36): n=c or t
tttacttaaagactttgtggactgctgccttttctnatattctcagccttacctttggttcactgcctctg

SEQ ID NO: 47987 - DNA, 71 bp, chicken (Gallus Gallus)
  misc_feature (36): n=g or t
atcaatcagcactccagtagttcaagctcacccttncgttcttaaacaagagcgatagctctgccaagccc

SEQ ID NO: 47988 - DNA, 71 bp, chicken (Gallus Gallus)
  misc_feature (36): n=a or g
atctacagcgagaagtttattagtgctgaatggctncatgtggagtggggaattttgctctgccaatcagc

SEQ ID NO: 47989 - DNA, 71 bp, chicken (Gallus Gallus)
  misc_feature (36): n=a or g
agggcaaagagcagacaagcatagggtcctatcccnctctgcacaccacttttgttgaatcagaccttcat

SEQ ID NO: 47990 - DNA, 71 bp, chicken (Gallus Gallus)
  misc_feature (36): n=c or t
ctttctgaatcccataagggccaagcttgtgcttangtttcctctgcagttagcaaagccattaggtggca

SEQ ID NO: 47991 - DNA, 71 bp, chicken (Gallus Gallus)
  misc_feature (36): n=c or t
ggggaagggattatgcatctaattattaggtccctntctgcacagccccttcaatctttgcactctgcaca

SEQ ID NO: 47992 - DNA, 71 bp, chicken (Gallus Gallus)
  misc_feature (36): n=a or g
tgccctctgacagccgtgaccggtgctgtcccctgntgctgtgcagctgctcctcaacattaacttctgct

SEQ ID NO: 47993 - DNA, 71 bp, chicken (Gallus Gallus)
  misc_feature (36): n=a or g
atccccccagcatccctgcatcaaacacaggctacntgtccaaagggaaccgaaggagcaccaaagtcagg

SEQ ID NO: 47994 - DNA, 71 bp, chicken (Gallus Gallus)
  misc_feature (36): n=c or t
agactggctaacttgttttgggctgttgtatcccangaaaccagaccagagcacccagaagagggcagaac

SEQ ID NO: 47995 - DNA, 71 bp, chicken (Gallus Gallus)
  misc_feature (36): n=c or t
gtctcaacttctgcttcagaagctgcactggaagtngctccatggtttttaagtaagggcaacactttaaa

SEQ ID NO: 47996 - DNA, 71 bp, chicken (Gallus Gallus)
  misc_feature (36): n=c or t
tgcagatggtgacagggccgggatggttccctcttnctgctttgaggaatgagggctggtgtgcacacagg

SEQ ID NO: 47997 - DNA, 71 bp, chicken (Gallus Gallus)
  misc_feature (36): n=a or g
ttatttcatgttctgatattattgtatagattaaantcgactggttaaacatttacgcgtgctttgaatta

SEQ ID NO: 47998 - DNA, 71 bp, chicken (Gallus Gallus)
  misc_feature (36): n=a or g
tgcttatgaaaatatcagcttaagaaataacatcancaacggatgggtggggataacattccccacaagaa

SEQ ID NO: 47999 - DNA, 71 bp, chicken (Gallus Gallus)
  misc_feature (36): n=c or t
agcttacaactgcatacacaagtttctcctacttcngagtcagaaggcatttcttcagatctgcacaggct

SEQ ID NO: 48000 - DNA, 71 bp, chicken (Gallus Gallus)
  misc_feature (36): n=a or c
ttctacatactggttggaagcttgcctacaagcttntgaaaaattttactgctcttacctctcacactgaa

SEQ ID NO: 48001 - DNA, 71 bp, chicken (Gallus Gallus)
  misc_feature (36): n=a or g
atgacaagcactcagcatttcatggcccctactttntcatgggctttttaaaaacctgcccctggtatttt

SEQ ID NO: 48002 - DNA, 71 bp, chicken (Gallus Gallus)
  misc_feature (36): n=c or t
ctctgtcaaagctttgttgctgggaggtggcatttnggttcctgccacattgcaggctgcagagagaaatc

SEQ ID NO: 48003 - DNA, 71 bp, chicken (Gallus Gallus)
  misc_feature (36): n=a or c
tctctgacactccttcagccagtttgcatagtcagntgcagtggggcataaccttaaaacaatgtatgaaa

SEQ ID NO: 48004 - DNA, 71 bp, chicken (Gallus Gallus)
  misc_feature (36): n=c or t
ttctaggaaaatggtgatgatcatttttcccctgtnctccttttgtcttcagcaaactagcaaaggaagtg

SEQ ID NO: 48005 - DNA, 71 bp, chicken (Gallus Gallus)
  misc_feature (36): n=a or g
caataaccaggccattaatgctggcttcccattatnttaagctggaagatgcccttggtatttatttagag

SEQ ID NO: 48006 - DNA, 71 bp, chicken (Gallus Gallus)
  misc_feature (36): n=a or g
gaaccaggctagggagcagcttcatatgaagaaatnccaagagtgtggaggggatgataatttctggtgaa

SEQ ID NO: 48007 - DNA, 71 bp, chicken (Gallus Gallus)
  misc_feature (36): n=a or g
agttcctaaatattaatgcatcaccttgtccctacnaagcgacaggactgttttatcaccataggcatgca

SEQ ID NO: 48008 - DNA, 71 bp, chicken (Gallus Gallus)
  misc_feature (36): n=c or t
ttcagtttacaatgaaaagcatttcttaagcctttnttatgtggataaacacttcatcagtagaagagttt

SEQ ID NO: 48009 - DNA, 71 bp, chicken (Gallus Gallus)
  misc_feature (36): n=a or g
gagcttcctgggacttttctggtgttgcatcttacntctgcaaagctgtatcttccaggatatgatgtgac

SEQ ID NO: 48010 - DNA, 71 bp, chicken (Gallus Gallus)
  misc_feature (36): n=a or g
agtgcgtcaccaccctcttgatgagggatctgaatnttgccctctcttgtggcatccctgtagtcaccagt

SEQ ID NO: 48011 - DNA, 71 bp, chicken (Gallus Gallus)
  misc_feature (36): n=c or t
cttgaggcaatgctattgtttgcatttgacatccanattcctgtgatcctggcagcgctgccagcaagcgg

SEQ ID NO: 48012 - DNA, 71 bp, chicken (Gallus Gallus)
  misc_feature (36): n=c or t
gccagaggtgcttcatgcacaattgcaactggacanacacatatcgcttcacatcaaccttttttcttttc

SEQ ID NO: 48013 - DNA, 71 bp, chicken (Gallus Gallus)
  misc_feature (36): n=a or c
ggttaatgtcaaaagtgattttgttttgttttaaangtagctattttgagtctcacttgcaacactgataa

SEQ ID NO: 48014 - DNA, 71 bp, chicken (Gallus Gallus)
  misc_feature (36): n=c or t
cttaatgtttctaatagataccatgggatgcaaganagctgtcagacatagcccagtgatttcagaggccc

SEQ ID NO: 48015 - DNA, 71 bp, chicken (Gallus Gallus)
  misc_feature (36): n=a or g
gcttttgcagcagtgtttattattttgtaactacangtcagcaaagagatgactgaaaacctgagataatc

SEQ ID NO: 48016 - DNA, 71 bp, chicken (Gallus Gallus)
  misc_feature (36): n=c or t
gcaagggagcagtatctctctggatagagatcatantccccttgagctactactggttattggaaggggtg

SEQ ID NO: 48017 - DNA, 71 bp, chicken (Gallus Gallus)
  misc_feature (36): n=a or g
aaatctgagggggagggagggggaagacattaaatntctccaccttttccttattccccttttgccgttgt

SEQ ID NO: 48018 - DNA, 71 bp, chicken (Gallus Gallus)
  misc_feature (36): n=a or g
taattatcctctaagtataggattatcaccctccangaataaagacctgtcatggcactggccatatggga

SEQ ID NO: 48019 - DNA, 71 bp, chicken (Gallus Gallus)
  misc_feature (36): n=a or g
tgtgctgaagtagatctggtgcccacagcacaaganaaacatggggctgttggagagggtccagaagaggg

SEQ ID NO: 48020 - DNA, 71 bp, chicken (Gallus Gallus)
  misc_feature (36): n=c or t
tgaaactaatgcaaatctgtcttgtgagaccatagntctttcaccatgttacatgtagtttgttggttaaa

SEQ ID NO: 48021 - DNA, 71 bp, chicken (Gallus Gallus)
  misc_feature (36): n=c or t
caatagaaactatccaaacaggttaaataggatagnatcccctagcacaaataatcactgaatcataatca

SEQ ID NO: 48022 - DNA, 71 bp, chicken (Gallus Gallus)
  misc_feature (36): n=a or g
ggaggggctgtgaagattaattagtgttttgtatgnggctttgaagatgtaaatcactgtgtaagggctta

SEQ ID NO: 48023 - DNA, 71 bp, chicken (Gallus Gallus)
  misc_feature (36): n=c or t
acagccagaaaagaagaactttgttgattgaaatcnatgcaaataagctagtcatccaaagacttgattca

SEQ ID NO: 48024 - DNA, 71 bp, chicken (Gallus Gallus)
  misc_feature (36): n=a or c
gcagagaatgctaaatgctggatctgagtctaaganaatgagaagaataaacatagcaatgcagagttagt

SEQ ID NO: 48025 - DNA, 71 bp, chicken (Gallus Gallus)
  misc_feature (36): n=c or t
tgtgatgtaaacgaaaagcttcttcacacctgtgcnccaccagtagcctgatcacatgtaattggcatggc

SEQ ID NO: 48026 - DNA, 71 bp, chicken (Gallus Gallus)
  misc_feature (36): n=a or g
gatgaggtgttcacagggctaaaaactcagttgtcnggaactagcaaaggttgggagagcaggtacagaat

SEQ ID NO: 48027 - DNA, 71 bp, chicken (Gallus Gallus)
  misc_feature (36): n=a or c
cttctgttaaggtcacatattccatgttgttcccanatcccagctaccattactacttgttggtagcctcc

SEQ ID NO: 48028 - DNA, 71 bp, chicken (Gallus Gallus)
  misc_feature (36): n=a or g
ggctctgcaggtgttcttaaggaaaacttgctctcnattccctcaaaattcatctcagcttctgctagaca

SEQ ID NO: 48029 - DNA, 71 bp, chicken (Gallus Gallus)
  misc_feature (36): n=a or g
acaaacagaaccttatttttgtaagtaatgtgaaanatggaacaatttcctaagctgtaacaagtagtgca

SEQ ID NO: 48030 - DNA, 71 bp, chicken (Gallus Gallus)
  misc_feature (36): n=a or g
tctctttgtatcctttatactttgaaccttagaganaccattaccctcattctcatttacctttttcacca

SEQ ID NO: 48031 - DNA, 71 bp, chicken (Gallus Gallus)
  misc_feature (36): n=c or t
tcccctaacaggttattttcattcctgactgatganattttgtaatgaactcagcagtgcactgaccatgg

SEQ ID NO: 48032 - DNA, 71 bp, chicken (Gallus Gallus)
  misc_feature (36): n=a or g
agactatttccagtgaggacacatctgtaacttttntagatggtactaaactgtcttcatgaactgaacag

SEQ ID NO: 48033 - DNA, 71 bp, chicken (Gallus Gallus)
  misc_feature (36): n=c or t
aggagcaagagagattgctattatctctgtgagctnttacccatttttaagataatgaatacacagagact

SEQ ID NO: 48034 - DNA, 71 bp, chicken (Gallus Gallus)
  misc_feature (36): n=a or g
gtgctctggagttgtgggggacaaactcccaagaancaatgtgcagcttcaaaaccccaaagtttggaaag

SEQ ID NO: 48035 - DNA, 71 bp, chicken (Gallus Gallus)
  misc_feature (36): n=a or g
gtcacatgtacagcaacaataagctgtgactgactnagtccagagttctcaattcatttgccctactacta

SEQ ID NO: 48036 - DNA, 71 bp, chicken (Gallus Gallus)
  misc_feature (36): n=c or t
tcactcaccagctgttctccacgcatgacttacttngcagctccgtggaaagcatggcatttgcaaaagac

SEQ ID NO: 48037 - DNA, 71 bp, chicken (Gallus Gallus)
  misc_feature (36): n=a or g
ttctggatttctgtcaatgctacacatactatttancacggaagaaattaataggcagactttgaggggat

SEQ ID NO: 48038 - DNA, 71 bp, chicken (Gallus Gallus)
  misc_feature (36): n=c or t
tagttaaaaaaaaaaggcaaaaatacatatatcagnagttatgctaatgagagttgccacctctgtgcatt

SEQ ID NO: 48039 - DNA, 71 bp, chicken (Gallus Gallus)
  misc_feature (36): n=c or t
tctcactgtagaagcaaaatcattgggctaatgagnagcatgctaaagatgagaggcaaaaggagatggac

SEQ ID NO: 48040 - DNA, 71 bp, chicken (Gallus Gallus)
  misc_feature (36): n=a or g
tcaagtattgttttggtaagagcctactacatgcanagcactgcagagtctgacgtaggatatgaccacgt

SEQ ID NO: 48041 - DNA, 71 bp, chicken (Gallus Gallus)
  misc_feature (36): n=a or c
actaactactttgctcagttttcaaaggcaaatcanatacgtaagtgtatgggaaaatttcaagactatag

SEQ ID NO: 48042 - DNA, 71 bp, chicken (Gallus Gallus)
  misc_feature (36): n=a or g
tacagaataccttggaaggtaaaatttgtaagaagnaggaatgtttctcatgagtatatgttatttattta

SEQ ID NO: 48043 - DNA, 71 bp, chicken (Gallus Gallus)
  misc_feature (36): n=c or t
cttcttgcaggacgttcatcttacttgtcaagttantaaatagagtttcctttttccaatctagagaggta

SEQ ID NO: 48044 - DNA, 71 bp, chicken (Gallus Gallus)
  misc_feature (36): n=a or g
attagtttggaaattttactgtgttttagcaatctntgtaattctttgagtaattcttctggggcttgctg

SEQ ID NO: 48045 - DNA, 71 bp, chicken (Gallus Gallus)
  misc_feature (36): n=a or g
gctatttggcatcttaatcatttacatcaacagtangatcaagtgtgccatcagcaagttggcatgcaagg

SEQ ID NO: 48046 - DNA, 71 bp, chicken (Gallus Gallus)
  misc_feature (36): n=c or t
aaagaactgtggctagcacatcaaagttgatcctgncccgctactctgagctggtgagacctcacccagag

SEQ ID NO: 48047 - DNA, 71 bp, chicken (Gallus Gallus)
  misc_feature (36): n=c or t
aatagcttgagaatgacatcagtcaactttcagtanccctacattcattcaccttagtccaacagtcttgc

SEQ ID NO: 48048 - DNA, 71 bp, chicken (Gallus Gallus)
  misc_feature (36): n=a or g
tttagatgaacaaaaaatctgtatgactgaggtgcnaagatgtggttgagagcctctggataacgattaag

SEQ ID NO: 48049 - DNA, 71 bp, chicken (Gallus Gallus)
  misc_feature (36): n=a or g
aaagaagtgaaattacacccaatgttcttggcaatnctggacgaagtattcacaggtagacccatagttac

SEQ ID NO: 48050 - DNA, 71 bp, chicken (Gallus Gallus)
  misc_feature (36): n=a or g
gactgtcccttggtaagcccatgttgataatgcccnataatagctttgctctttaactgactttcaatatc

SEQ ID NO: 48051 - DNA, 71 bp, chicken (Gallus Gallus)
  misc_feature (36): n=c or t
aactgaggaagaactgctccaaagtagccactgctnggtgagctacagggaatcagtctggtggtagtagg

SEQ ID NO: 48052 - DNA, 71 bp, chicken (Gallus Gallus)
  misc_feature (36): n=a or g
gacatgctagcaatgctgtgactgatgcactccatnggatggttagcctttctggttgtctggacacactg

SEQ ID NO: 48053 - DNA, 71 bp, chicken (Gallus Gallus)
  misc_feature (36): n=a or g
ggaacttaagacctctcatgctatggctgtgagctnggagaagaagctaaccccaccacaccacaacctct

SEQ ID NO: 48054 - DNA, 71 bp, chicken (Gallus Gallus)
  misc_feature (36): n=c or t
tactgcatctacttctagcactcccagcaaaagagnggttggagtgggtcctgcagagggccactaagatg

SEQ ID NO: 48055 - DNA, 71 bp, chicken (Gallus Gallus)
  misc_feature (36): n=c or t
caatcccatcagggccactgaattgtggaaagatantgttacccaggtagacaacattgctataaaagcat

SEQ ID NO: 48056 - DNA, 71 bp, chicken (Gallus Gallus)
  misc_feature (36): n=c or t
acagagccaaacttttctccatgattccagaaaganagcaaaaacagaggccataattgtagctcaggagg

SEQ ID NO: 48057 - DNA, 71 bp, chicken (Gallus Gallus)
  misc_feature (36): n=c or t
attctcttggtaggaaaggtggggggcaggcagggntttggtgatgcttcctcgttgggttttagcaacag

SEQ ID NO: 48058 - DNA, 71 bp, chicken (Gallus Gallus)
  misc_feature (36): n=a or g
gcatggaattattgctcctgcaacactgcaggtcanttggcagcagcagaggtgttctgtgctctggaagc

SEQ ID NO: 48059 - DNA, 71 bp, chicken (Gallus Gallus)
  misc_feature (36): n=c or t
gactacacgtagttactgctgactgaaaaccagacngaaagaagacaagagtggagtgtttggatctggaa

SEQ ID NO: 48060 - DNA, 71 bp, chicken (Gallus Gallus)
  misc_feature (36): n=a or g
cactggggcagggctaacgccggctctgcagaagtncattaggagctgctctgtggatgagattaggggca

SEQ ID NO: 48061 - DNA, 71 bp, chicken (Gallus Gallus)
  misc_feature (36): n=a or g
gcagagcgcttgggctgccgcgcttgcaggctgcanagctagaagtgaactttcttggtgagagccatctg

SEQ ID NO: 48062 - DNA, 71 bp, chicken (Gallus Gallus)
  misc_feature (36): n=c or t
gcaccatcatttttccctcagtattcctggcatgtnacaaatcactgctcggttactgacttggaaatggt

SEQ ID NO: 48063 - DNA, 71 bp, chicken (Gallus Gallus)
  misc_feature (36): n=c or t
caaaagcatgctggatccagcaaattataggacagntgagaagggcagcatgatctgggttgtagtaaatg

SEQ ID NO: 48064 - DNA, 71 bp, chicken (Gallus Gallus)
  misc_feature (36): n=c or t
gacttacatatttagctgctacttagggtagccacngagtcttaatttgtgagcactgaattggagacagt

SEQ ID NO: 48065 - DNA, 71 bp, chicken (Gallus Gallus)
  misc_feature (36): n=c or t
aaaaatctatgtgaagggcttgcatatcgttctttnccagtatctcatttccttgtggctataataataaa

SEQ ID NO: 48066 - DNA, 71 bp, chicken (Gallus Gallus)
  misc_feature (36): n=a or c
ccgacaaaactatgtttctgtttgttcccatacctncagttaagtcactgggcaactatgaaaagagcctg

SEQ ID NO: 48067 - DNA, 71 bp, chicken (Gallus Gallus)
  misc_feature (36): n=c or t
tatatatatatgaattttaatcatgctacaacatanatcatataatgtgagtagtgataaacagggtagct

SEQ ID NO: 48068 - DNA, 71 bp, chicken (Gallus Gallus)
  misc_feature (36): n=a or g
tgggaatgcaggtagtgaggttcccatcaatcctcncttcctcatgtgttcttatgctcggcacaatttat

SEQ ID NO: 48069 - DNA, 71 bp, chicken (Gallus Gallus)
  misc_feature (36): n=a or g
cagtggggatgtgaagaagtctagcattaaatgcgnaggttggtgaccctgcatgtggccggggggctgga

SEQ ID NO: 48070 - DNA, 71 bp, chicken (Gallus Gallus)
  misc_feature (36): n=a or g
cactttatcttctccgtccttgcctgttcttactgnacagcttatagacatcaatagccacatttcaatca

SEQ ID NO: 48071 - DNA, 71 bp, chicken (Gallus Gallus)
  misc_feature (36): n=g or t
tttgcatttgtttcatccagttaagtggagaactgntcagtggcaccaaaatgctgttcattaatttttca

SEQ ID NO: 48072 - DNA, 71 bp, chicken (Gallus Gallus)
  misc_feature (36): n=a or g
tgatgcatagggaaaggctcagggaacaggtttttnttcagtctggaaaagtggaggctaagagtgaagtc

SEQ ID NO: 48073 - DNA, 71 bp, chicken (Gallus Gallus)
  misc_feature (36): n=c or t
ccaagcaaagtccccggggactggaaaaagggaaanatgcctcccatttataaaaagggtaaagaaagaac

SEQ ID NO: 48074 - DNA, 71 bp, chicken (Gallus Gallus)
  misc_feature (36): n=a or g
atcaagttgtttgattagtcctggcttcatacaatnacatcttacaaaacacacttatatggcaaacaggt

SEQ ID NO: 48075 - DNA, 71 bp, chicken (Gallus Gallus)
  misc_feature (36): n=c or t
tgatgaacaagggaagagtctccttttcttgttttngaatgagataaagcagcaatccctttcagttcact

SEQ ID NO: 48076 - DNA, 71 bp, chicken (Gallus Gallus)
  misc_feature (36): n=c or t
agtaagcagagacacctgcagctcattcaggtgctnggagcccaaccagcttttaccttgagtgtccctca

SEQ ID NO: 48077 - DNA, 71 bp, chicken (Gallus Gallus)
  misc_feature (36): n=a or g
aaaataacttccttaaagtatccccagccttcctgngttgggagcgcctgtgcgtatgtgcatgcacgtgt

SEQ ID NO: 48078 - DNA, 71 bp, chicken (Gallus Gallus)
  misc_feature (36): n=a or g
ttggttactgaatttatgtttcagcaccacgttagnctgttactttcatttgtttcaccatgcttcttgat

SEQ ID NO: 48079 - DNA, 71 bp, chicken (Gallus Gallus)
  misc_feature (36): n=a or g
atcagcgtgcttccctctcccatgagatgtgaatcntaggatcattaaggttggaaaagacctctaagatc

SEQ ID NO: 48080 - DNA, 71 bp, chicken (Gallus Gallus)
  misc_feature (36): n=a or c
caacacttgaggaaagtgatcattcccccctgctgnataggtgaagccataactggaaagttttaaaatca

SEQ ID NO: 48081 - DNA, 71 bp, chicken (Gallus Gallus)
  misc_feature (36): n=a or g
ccagtgcatgatcagtacagcccaggcagcccccantcctgatattgccaatcagttcactttacattggt

SEQ ID NO: 48082 - DNA, 71 bp, chicken (Gallus Gallus)
  misc_feature (36): n=c or t
tttatttatttatttattgttgataatttgggtacnttgggtacttatcagtgataatacaacaacagctg

SEQ ID NO: 48083 - DNA, 71 bp, chicken (Gallus Gallus)
  misc_feature (36): n=a or g
ttgagcagaaatctgtaccaggctggcctcctgagntcccttctacactaaattttcataggataaaagat

SEQ ID NO: 48084 - DNA, 71 bp, chicken (Gallus Gallus)
  misc_feature (36): n=c or t
aactgggtatatcatgtggaagttcatatgtgtaangcatcttctgggatggtctttggtgagaggattga

SEQ ID NO: 48085 - DNA, 71 bp, chicken (Gallus Gallus)
  misc_feature (36): n=c or t
atagcagtgacgccacttatcctcaccagaggctangtgatccaggagcctgtcaccttcaacctcatatc

SEQ ID NO: 48086 - DNA, 71 bp, chicken (Gallus Gallus)
  misc_feature (36): n=c or t
taactgaagacagagactatcatttatcctgcttcnggctcacaggaagctggaatagaatcagagaatca

SEQ ID NO: 48087 - DNA, 71 bp, chicken (Gallus Gallus)
  misc_feature (36): n=a or g
tctacctaggactttattcatcttgttctcatgacntatttacctttccataagctgttttgaaggagagg

SEQ ID NO: 48088 - DNA, 71 bp, chicken (Gallus Gallus)
  misc_feature (36): n=c or t
ccccgaaccacactggaaataaggcaaagataagancattagcttataaaatacttaaaatatctttaaaa

SEQ ID NO: 48089 - DNA, 71 bp, chicken (Gallus Gallus)
  misc_feature (36): n=c or t
catttttgtttcaaactgcaagttagttcaaacccngcagtggaatcttgaaacactatctctgaaatgtg

SEQ ID NO: 48090 - DNA, 71 bp, chicken (Gallus Gallus)
  misc_feature (36): n=a or g
tttgactgtcaattgaaaatccaaaaatcttggaanggggttgctattttagctttttgaaacactgttag

SEQ ID NO: 48091 - DNA, 71 bp, chicken (Gallus Gallus)
  misc_feature (36): n=a or g
aaccatcaacctatttctaccatgtccgctcaaccntgtccttcggtgtcacatctacatgtttcttgaac

SEQ ID NO: 48092 - DNA, 71 bp, chicken (Gallus Gallus)
  misc_feature (36): n=c or t
ggcacagactctttaactcattcagctctgtgatgngctcacttctgctggggtttaaatttattaggttt

SEQ ID NO: 48093 - DNA, 71 bp, chicken (Gallus Gallus)
  misc_feature (36): n=c or t
agagttaaaactgtttcacacacactcatggtattnacctctgaaattttttgttggcttggaggttataa

SEQ ID NO: 48094 - DNA, 71 bp, chicken (Gallus Gallus)
  misc_feature (36): n=a or g
atggtagagattgatgaatatatttgatttagaagnattcacagaagcatcaatgttttccattttcttcc

SEQ ID NO: 48095 - DNA, 71 bp, chicken (Gallus Gallus)
  misc_feature (36): n=c or t
tatatcactaacaacaacctttgttcattttaacangaaaacgtgcccttccacagctgtttcatcagctt

SEQ ID NO: 48096 - DNA, 71 bp, chicken (Gallus Gallus)
  misc_feature (36): n=c or t
tggttacacggtaatttaccagcagaccaaatacgngcatgcttaatttgtaccaaacgactacaagaacc

SEQ ID NO: 48097 - DNA, 71 bp, chicken (Gallus Gallus)
  misc_feature (36): n=a or g
acaagaaaacaaacaaacaaacaaaaagacctcacnaggcagcatgcagtttgatcacctcgacctcaatg

SEQ ID NO: 48098 - DNA, 71 bp, chicken (Gallus Gallus)
  misc_feature (36): n=a or g
gaaaactggagatctagtacttctctgacaacaaantgttagaaaatttggccttttttgtccactttctt

SEQ ID NO: 48099 - DNA, 71 bp, chicken (Gallus Gallus)
  misc_feature (36): n=a or g
tagtactactgcagtctgatttcacttcaaggtgcnggttgtactaaagcaagctgcattctggtgaacta

SEQ ID NO: 48100 - DNA, 71 bp, chicken (Gallus Gallus)
  misc_feature (36): n=c or t
ttattactgctgctaaagataacttgagctctgttnggttttaagcctgttcacagaatcacagaagtgaa

SEQ ID NO: 48101 - DNA, 71 bp, chicken (Gallus Gallus)
  misc_feature (36): n=c or t
gaaaggatctgaattttttcatggtacatagaacancttagaagagcaggctactctaccgctcacagctt

SEQ ID NO: 48102 - DNA, 71 bp, chicken (Gallus Gallus)
  misc_feature (36): n=c or t
gttgtcagttgggctgaaaaggcacattcctccttntatggcaaggtgtattctgctggagtctccagcac

SEQ ID NO: 48103 - DNA, 71 bp, chicken (Gallus Gallus)
  misc_feature (36): n=a or g
taatacaccaattctggtgatatattatactttctnggccatgaaaccgagtgtttatgtgcagtgagtat

SEQ ID NO: 48104 - DNA, 71 bp, chicken (Gallus Gallus)
  misc_feature (36): n=c or t
aactcaggatgttctatggttctgacaccaaaatcntatgcagatgtctacttagtcagtatgtcatacct

SEQ ID NO: 48105 - DNA, 71 bp, chicken (Gallus Gallus)
  misc_feature (36): n=a or g
tgagactgtgcacacagaacagctctgcactcatancccttttccttccagtttgtcattgctgacctagc

SEQ ID NO: 48106 - DNA, 71 bp, chicken (Gallus Gallus)
  misc_feature (36): n=a or g
ttcttctagggaagcatcctgtagaaatcgagtaanagttaaagacctaatttcccttcaacacatacact

SEQ ID NO: 48107 - DNA, 71 bp, chicken (Gallus Gallus)
  misc_feature (36): n=a or c
ggttttgtcactgtcaaatgactgcatgaaactaanaactatggctaataggagcagtggaggaactaatc

SEQ ID NO: 48108 - DNA, 71 bp, chicken (Gallus Gallus)
  misc_feature (36): n=c or t
ctttgctccagactccctgaagagccaccacagtcngggaagccccaaaatgtctgggtcaaagcttactc

SEQ ID NO: 48109 - DNA, 71 bp, chicken (Gallus Gallus)
  misc_feature (36): n=c or t
accaactctctcagcacctttgggcggatctcatcnagccccatggacttgtggcagtccaagtggagtag

SEQ ID NO: 48110 - DNA, 71 bp, chicken (Gallus Gallus)
  misc_feature (36): n=c or t
gcttgaagtgtaactgcagtgataatcactgaaagngtgcacagatacccagggaaatgccctttctctga

SEQ ID NO: 48111 - DNA, 71 bp, chicken (Gallus Gallus)
  misc_feature (36): n=g or t
gcaaaaagcattttgccacctggcctctccagacanaaacagatcctgtaagattatctaggcttgtataa

SEQ ID NO: 48112 - DNA, 71 bp, chicken (Gallus Gallus)
  misc_feature (36): n=a or g
acgggagcaccatcagcaaccacacagggcactccngtccttcgggctgtgagcagtgtgcatttaccttt

SEQ ID NO: 48113 - DNA, 71 bp, chicken (Gallus Gallus)
  misc_feature (36): n=a or g
ggaggttcacccttcttgaaggctgacagaactacnctagtagcgcagaatttcaagggcaccagacaaag

SEQ ID NO: 48114 - DNA, 71 bp, chicken (Gallus Gallus)
  misc_feature (36): n=a or g
aagttagtcttgaatgaatcttgtagtttgagatcnattttcttcaatgtaattgttaattaaaatagaag

SEQ ID NO: 48115 - DNA, 71 bp, chicken (Gallus Gallus)
  misc_feature (36): n=a or g
agaaacaaagaggccccaataacctcccctagtttntagaaaaacaactgctttgtacatggataaattta

SEQ ID NO: 48116 - DNA, 71 bp, chicken (Gallus Gallus)
  misc_feature (36): n=a or g
gctgctcagttcgctctgaggagagctggaacagtncatgtagcatggcagtttctgaaggtgatgtccac

SEQ ID NO: 48117 - DNA, 71 bp, chicken (Gallus Gallus)
  misc_feature (36): n=c or t
gactgacatacgccttcaaactcttaaccagagcangttgtgtacgctaggaacacttagaatacagcttg

SEQ ID NO: 48118 - DNA, 71 bp, chicken (Gallus Gallus)
  misc_feature (36): n=a or g
atctaggctcagatctgagggacagtctattctggnagcttacatgaaaccaggtgacatccacgccttgt

SEQ ID NO: 48119 - DNA, 71 bp, chicken (Gallus Gallus)
  misc_feature (36): n=a or g
ttaaatacaagtattgaagtgatgaggggaatgcantggccctttgctgagctaaaattctcagccaatct

SEQ ID NO: 48120 - DNA, 71 bp, chicken (Gallus Gallus)
  misc_feature (36): n=c or t
aggttgagtaaataggcgaaatagcctttccatcanttaatgtcaaaaggcttaaatataatcgtgctggg

SEQ ID NO: 48121 - DNA, 71 bp, chicken (Gallus Gallus)
  misc_feature (36): n=a or c
tattgcagaagtgatgactaggctgtgcttttctcntcattgcaaggtggggggtgtgaggacagggcaga

SEQ ID NO: 48122 - DNA, 71 bp, chicken (Gallus Gallus)
  misc_feature (36): n=a or g
tttgggaagtttgcttttttatttgtttaaaacagnccaagtgagttggaagtcgaaataagttgtctaaa

SEQ ID NO: 48123 - DNA, 71 bp, chicken (Gallus Gallus)
  misc_feature (36): n=c or t
gctatgtgttggagaagcactggcaaccttctcccntaaagctaacagttgcatctttcttttagaaaata

SEQ ID NO: 48124 - DNA, 71 bp, chicken (Gallus Gallus)
  misc_feature (36): n=c or t
tttctccctcctcccccctcttccatatttgtatgngagtagaagtatattttctaagaaagaaattgtgt

SEQ ID NO: 48125 - DNA, 71 bp, chicken (Gallus Gallus)
  misc_feature (36): n=a or g
agaaacaaagcaaaaaactggatggcaaaatgtcantcaaatcagatttaagttctctaaggtggcagtga

SEQ ID NO: 48126 - DNA, 71 bp, chicken (Gallus Gallus)
  misc_feature (36): n=c or t
cctcctgcacaagctgtcccaagtctttgatcacangtaccagcgcttctaggctccacatcttgagtcat

SEQ ID NO: 48127 - DNA, 71 bp, chicken (Gallus Gallus)
  misc_feature (36): n=c or t
tgatatggtgtggtggagagatcccagatttcctangaatctgagagattagagtgatgcagctgactgtg

SEQ ID NO: 48128 - DNA, 71 bp, chicken (Gallus Gallus)
  misc_feature (36): n=a or g
cacctgcttcagactgtcccatagtgaagacttgcnttgttttttatcctttactggtaagattgtagtta

SEQ ID NO: 48129 - DNA, 71 bp, chicken (Gallus Gallus)
  misc_feature (36): n=c or t
gcaatgaaagcgtgtgtcaagcaggaggaatgggtnatggtgggatggatgctcttgccttcccaagagat

SEQ ID NO: 48130 - DNA, 71 bp, chicken (Gallus Gallus)
  misc_feature (36): n=a or g
caagattcgtcctgccttctcaggggacaaacatcntctgcatgaccactgagaccattggagagtgcagc

SEQ ID NO: 48131 - DNA, 71 bp, chicken (Gallus Gallus)
  misc_feature (36): n=a or g
agacccctaaactgttttcaaatgtctgatggcaantatcacagaagggttttatccatttttattatttt

SEQ ID NO: 48132 - DNA, 71 bp, chicken (Gallus Gallus)
  misc_feature (36): n=a or g
cttaaatgtaacgacactgcacacatctgcaagatntggaactagccaactaaggcaaatgagatacagaa

SEQ ID NO: 48133 - DNA, 71 bp, chicken (Gallus Gallus)
  misc_feature (36): n=a or g
agaaagttgttttagcttaaagtcattactacatgntctctaactacagtccattatatacgaggttccca

SEQ ID NO: 48134 - DNA, 71 bp, chicken (Gallus Gallus)
  misc_feature (36): n=c or t
catggttgctctgccctgactctcattccatgtaanatggtaatactgtgtacgccagcaaaggaaagcca

SEQ ID NO: 48135 - DNA, 71 bp, chicken (Gallus Gallus)
  misc_feature (36): n=a or g
tgagtgccgagctctccatcatgcaggcattcttcngcctgaacatcaccaatggcatggtggggtaacac

SEQ ID NO: 48136 - DNA, 71 bp, chicken (Gallus Gallus)
  misc_feature (36): n=a or g
accctattaaaaagcctgttgccttctttctcatancactcctttagctatttaaaggctactctcagact

SEQ ID NO: 48137 - DNA, 71 bp, chicken (Gallus Gallus)
  misc_feature (36): n=c or t
actagagaatcttgtgataaagacctagacaggttngagcagtgagcacaggagaaactcacgaacttaaa

SEQ ID NO: 48138 - DNA, 71 bp, chicken (Gallus Gallus)
  misc_feature (36): n=a or g
gtgcaggcttgggaaggtacgtcttcaaaacaaaangcaaagagagaagagttaacaccgacgtacaacca

SEQ ID NO: 48139 - DNA, 71 bp, chicken (Gallus Gallus)
  misc_feature (36): n=a or g
tcttaaatgcacatcaagcatctctaagcgggaccncgtatggaagtgaagttacttacagttgtattcat

SEQ ID NO: 48140 - DNA, 71 bp, chicken (Gallus Gallus)
  misc_feature (36): n=c or t
tgcccagtgtgtcagagcttacgtggcggtagaatnctctggacttctggcaaaattcatcctgctgaaca

SEQ ID NO: 48141 - DNA, 71 bp, chicken (Gallus Gallus)
  misc_feature (36): n=c or g
tgcactggagcttgggcaaggatgcaaatgcgaaangaaaacaagactacttttctgagtggaaagtagcc

SEQ ID NO: 48142 - DNA, 71 bp, chicken (Gallus Gallus)
  misc_feature (36): n=c or g
tatttaggtagctcatgtgtctttgccacctaaatnagggactaaaaataggaaagggagtagtaaaatta

SEQ ID NO: 48143 - DNA, 71 bp, chicken (Gallus Gallus)
  misc_feature (36): n=a or t
caactggtattccatgataataaatacacaataggntaactttgtatgattttgattgttccaaagagaag

SEQ ID NO: 48144 - DNA, 71 bp, chicken (Gallus Gallus)
  misc_feature (36): n=c or g
acaagagattttagctttaagatttctccttcaganctttcacagtggattcacagaagggagacatttca

SEQ ID NO: 48145 - DNA, 71 bp, chicken (Gallus Gallus)
  misc_feature (36): n=c or g
cggccccagcctgtgtagggctccatttcctcttgncagaggtaatacagccttccacaagcaggctgaga

SEQ ID NO: 48146 - DNA, 71 bp, chicken (Gallus Gallus)
  misc_feature (36): n=c or g
acttcaaagccagttagagtgtagcatctaaccctncagaagagaatataatcttactgtaatacaggaag

SEQ ID NO: 48147 - DNA, 71 bp, chicken (Gallus Gallus)
  misc_feature (36): n=a or t
ggaagaaattgagtgaatggaaacggtttgatgagnataggaactgaagtcagattgcttcattttttctt

SEQ ID NO: 48148 - DNA, 71 bp, chicken (Gallus Gallus)
  misc_feature (36): n=c or g
gggattaacattttaagtcaggctttgaatcaaacnaaaggcaaactgaagcttaaaaatagctgaaggaa

SEQ ID NO: 48149 - DNA, 71 bp, chicken (Gallus Gallus)
  misc_feature (36): n=c or g
tgaagtcagaatatttaacaggctggctctctcatncccagttcattcctcaggtggctcagcaacggaac

SEQ ID NO: 48150 - DNA, 71 bp, chicken (Gallus Gallus)
  misc_feature (36): n=a or t
tggcagaaacacatacaaatgtaagggttgttcgcnactgtttcacaaggacagtaaactctgctagtcta

SEQ ID NO: 48151 - DNA, 71 bp, chicken (Gallus Gallus)
  misc_feature (36): n=c or g
caaaaggaaggtgattcatgcatggggctaagcctnccttttcctcataagccaagctttttagtttttat

SEQ ID NO: 48152 - DNA, 71 bp, chicken (Gallus Gallus)
  misc_feature (36): n=a or t
aaatgtctaacaggataaatcttctgttatataggngggccagctctgtttaagtactttgtatgaggaat

SEQ ID NO: 48153 - DNA, 71 bp, chicken (Gallus Gallus)
  misc_feature (36): n=c or g
taaatctgcctgtgcatacctaattatgatttgaanattcaagttttaaaatgaccatatacttctttgcc

SEQ ID NO: 48154 - DNA, 71 bp, chicken (Gallus Gallus)
  misc_feature (36): n=c or g
tttgagaatattatagccgaaaaaggagtattctgntgtagatgaaaacaagctcttcttgcctgcctctt

SEQ ID NO: 48155 - DNA, 71 bp, chicken (Gallus Gallus)
  misc_feature (36): n=a or t
ggaacctgtttattagctttgaagtcttctattggncccagcagtttatatctcatctttttaacacaagt

SEQ ID NO: 48156 - DNA, 71 bp, chicken (Gallus Gallus)
  misc_feature (36): n=a or t
agtgagctaacaggctccttttgttactttggtgtntgatgttcagagtcactgttagtggttacaattgc

SEQ ID NO: 48157 - DNA, 71 bp, chicken (Gallus Gallus)
  misc_feature (36): n=c or g
ggggaagtaatttagagttttagaaatactttaagnttgctactctttactcacacacgtgaaatcctaat

SEQ ID NO: 48158 - DNA, 71 bp, chicken (Gallus Gallus)
  misc_feature (36): n=c or g
ttacacctcattgtgcctgccacatccccccctgcnaaaggagagatggcttccagatgttgcagtccaac

SEQ ID NO: 48159 - DNA, 71 bp, chicken (Gallus Gallus)
  misc_feature (36): n=c or g
ctaactcgggaaaaatcttaatctccttttaaaggnttttactgctataagctcagaattaaatcacatca

SEQ ID NO: 48160 - DNA, 71 bp, chicken (Gallus Gallus)
  misc_feature (36): n=a or t
accaccagagaagcgtccagttctgaatatggtganttgatcgtttcattcctgaaacctcagtaacaagc

SEQ ID NO: 48161 - DNA, 71 bp, chicken (Gallus Gallus)
  misc_feature (36): n=a or t
ggttccttaatatacagtagtctactgggcaagctnaggtgttggcaatgtcagaataacttgatgtattt

SEQ ID NO: 48162 - DNA, 71 bp, chicken (Gallus Gallus)
  misc_feature (36): n=c or g
gtgccagctgccaggcatggcactgtttctacttantactgcaacatagagccagatctgttaacccagca

SEQ ID NO: 48163 - DNA, 71 bp, chicken (Gallus Gallus)
  misc_feature (36): n=c or g
ttagcagtaaggatggactgtactgatcaggagcangatatagccagtgagcaattagaaactggttatac

SEQ ID NO: 48164 - DNA, 71 bp, chicken (Gallus Gallus)
  misc_feature (36): n=c or g
aggcacgttatggcctccaaaacaactctgtattanagtacattgtttgcagcttgcccgctttccacctg

SEQ ID NO: 48165 - DNA, 71 bp, chicken (Gallus Gallus)
  misc_feature (36): n=a or t
aaacagccatcaggcaattaagaccagaatagacangcctttggcaaacagttttaagagtctaaatatgg

SEQ ID NO: 48166 - DNA, 71 bp, chicken (Gallus Gallus)
  misc_feature (36): n=c or g
ctactggtttgtttccctgtgccaattaaattcttncttatatgaattgttaattactgtaaaagttgttc

SEQ ID NO: 48167 - DNA, 71 bp, chicken (Gallus Gallus)
  misc_feature (36): n=c or g
gtaagtcttacagcagtgttttggtgttcactgatntggaataagcactaatacaaacacatagcaaagag

SEQ ID NO: 48168 - DNA, 71 bp, chicken (Gallus Gallus)
  misc_feature (36): n=a or t
ctgccttaactgaaagtgtcttctcatgtaaggttncataatactggagaaattgcaactagtgtgtcatg

SEQ ID NO: 48169 - DNA, 71 bp, chicken (Gallus Gallus)
  misc_feature (36): n=a or t
gacttcttgaagatcaggcaaaagccagccccaaanacgacacagagtgagagaattgcccgagttggaag

SEQ ID NO: 48170 - DNA, 71 bp, chicken (Gallus Gallus)
  misc_feature (36): n=a or t
tgtggacgctcttttctttgttcttccagaactgtnggtacatctggttttacagcatacccagctttcca

SEQ ID NO: 48171 - DNA, 71 bp, chicken (Gallus Gallus)
  misc_feature (36): n=a or t
taagcacaggaatttatacgtgaaatggaaatcagngctttgattgttgtgattatggtgtttctacatgt

SEQ ID NO: 48172 - DNA, 71 bp, chicken (Gallus Gallus)
  misc_feature (36): n=a or t
ttcagacaacatttagaattcacattaattctttgnttttctgattctcttacagttttgaaatgaacaat

SEQ ID NO: 48173 - DNA, 71 bp, chicken (Gallus Gallus)
  misc_feature (36): n=c or g
atttggtaaatcagactatgaattccccatgaattntctggatttacatttatgagcagcatctagccttg

SEQ ID NO: 48174 - DNA, 71 bp, chicken (Gallus Gallus)
  misc_feature (36): n=c or g
ctgctcaggtggttgggagccaccaagcaaggtagnaaaagacacactggatgaaattgcaagttcagacc

SEQ ID NO: 48175 - DNA, 71 bp, chicken (Gallus Gallus)
  misc_feature (36): n=a or t
tttgcacaagttaaaagctatggacttagaggcagntcagaaaacctccctgaattctacagaatatgggt

SEQ ID NO: 48176 - DNA, 71 bp, chicken (Gallus Gallus)
  misc_feature (36): n=c or g
tgaggtgctgggctttctgactccagccccgagcantgcttgagaacaagcctgactttgagaaagtgagt

SEQ ID NO: 48177 - DNA, 71 bp, chicken (Gallus Gallus)
  misc_feature (36): n=a or t
atggattaaaaaaatctgaagcagcaatgcatactnaatgacctgttcctgggagtaaattatggctggat

SEQ ID NO: 48178 - DNA, 71 bp, chicken (Gallus Gallus)
  misc_feature (36): n=a or t
acaaaaccaggatgtgttgtgtgtgcctcttggacntttgctgttggatcaatttgtccctcaagaactta

SEQ ID NO: 48179 - DNA, 71 bp, chicken (Gallus Gallus)
  misc_feature (36): n=a or t
agtcttcttctcagtgtgatcttctgatacagcttntgagaacagagccatttaccaccatattttactga

SEQ ID NO: 48180 - DNA, 71 bp, chicken (Gallus Gallus)
  misc_feature (36): n=c or g
aattaatgctattcaatttctcagttaccaggtgancacttgatattttatttgcaaccatctgtgccttt

SEQ ID NO: 48181 - DNA, 71 bp, chicken (Gallus Gallus)
  misc_feature (36): n=c or g
tgctgctcttaagaggatggtcagagtttagataantacagattggattatcttcattttgtagatgacct

SEQ ID NO: 48182 - DNA, 71 bp, chicken (Gallus Gallus)
  misc_feature (36): n=a or t
acaacccaagaactacagcatgaagttttagttggntccccacataagtggatctgcatgtttaagacagt

SEQ ID NO: 48183 - DNA, 71 bp, chicken (Gallus Gallus)
  misc_feature (36): n=c or g
cttacctcagcaacagtctgagtatcactgaaattnacaaaggcaaaaaccaaagaagctaaaggtgtttt

SEQ ID NO: 48184 - DNA, 71 bp, chicken (Gallus Gallus)
  misc_feature (36): n=c or g
cttaagcagtctgagctaatggtttttattcatgtncatcttactgaactggcaggtcaagtcacccaagg

SEQ ID NO: 48185 - DNA, 71 bp, chicken (Gallus Gallus)
  misc_feature (36): n=c or g
aactgtgcttcttggaaaagccaggctaaaggaagntcagtccagtgttaaaaggaacagcagtgatttcc

SEQ ID NO: 48186 - DNA, 71 bp, chicken (Gallus Gallus)
  misc_feature (36): n=a or t
gtctttatagtttcaaatttctgagattgttttggnaaggggaagagaagagtgcaagagtggcaaaagca

SEQ ID NO: 48187 - DNA, 71 bp, chicken (Gallus Gallus)
  misc_feature (36): n=c or g
agtgtacatggttacttcatgctcactcagccaatntgcagcacagactgaactgaaagccctgtaggttt

SEQ ID NO: 48188 - DNA, 71 bp, chicken (Gallus Gallus)
  misc_feature (36): n=c or g
tagattgatggctttcaattgcaaaacctggtaganatgctgatgatatatgtcatggctcacattaaatc

SEQ ID NO: 48189 - DNA, 71 bp, chicken (Gallus Gallus)
  misc_feature (36): n=c or g
tgctaagaaccataatgcctgaaacatgattccctnttgcttatttagttcaataaattcataaaagaatg

SEQ ID NO: 48190 - DNA, 71 bp, chicken (Gallus Gallus)
  misc_feature (36): n=a or t
ggttttcaccgaatggttactgtttcattgaatgcngtgttggatatttgaatgagtgagtttcattcttt

SEQ ID NO: 48191 - DNA, 71 bp, chicken (Gallus Gallus)
  misc_feature (36): n=a or t
aattcatccatcagaccgtaagcctcttagcactgntacctccactctgaactctttgagtatgcatacta

SEQ ID NO: 48192 - DNA, 71 bp, chicken (Gallus Gallus)
  misc_feature (36): n=a or t
tgaatagtaggctgcagttaccaaatgagccaaaantctctgcatggtattgccagcactgtttgtgggaa

SEQ ID NO: 48193 - DNA, 71 bp, chicken (Gallus Gallus)
  misc_feature (36): n=c or g
aattgtcacgctatagtagtgaagatcagttagctncatttggaaggttgtgttctcatgtacatcgtatg

SEQ ID NO: 48194 - DNA, 71 bp, chicken (Gallus Gallus)
  misc_feature (36): n=a or t
gctgagagaagggcagacagagttaggattaggacngttcccaacaggatcctttggtctcattgttaatg

SEQ ID NO: 48195 - DNA, 71 bp, chicken (Gallus Gallus)
  misc_feature (36): n=a or t
cgctttgtaaggtgttggtcaactggaaaaagtacngcaagcacgtgctttgccatgccagacccagcttg

SEQ ID NO: 48196 - DNA, 71 bp, chicken (Gallus Gallus)
  misc_feature (36): n=c or g
ccatgtacattttgcagaagggggctaaggaacttnagggtatgtcaggattgcagacgccttttgtgttt

SEQ ID NO: 48197 - DNA, 71 bp, chicken (Gallus Gallus)
  misc_feature (36): n=c or g
ctcatgaagttaaccctgatgacttaaagatgtaanagtcttccttaaaataacacagcactctgtgatag

SEQ ID NO: 48198 - DNA, 71 bp, chicken (Gallus Gallus)
  misc_feature (36): n=a or t
taaaatttttaatctagctcatttaaactgacacancaaatagaatagataatctaaggtaaagagcatta

SEQ ID NO: 48199 - DNA, 71 bp, chicken (Gallus Gallus)
  misc_feature (36): n=c or g
agccagcagattcgtataattctgcggtactattgntcttttgtcacaagcatataaataccctttacaga

SEQ ID NO: 48200 - DNA, 71 bp, chicken (Gallus Gallus)
  misc_feature (36): n=c or g
caaggattattacttgtaaaatgttgtttctcttantaatgagagtgtttgtagtaagatgatcctcattc

SEQ ID NO: 48201 - DNA, 71 bp, chicken (Gallus Gallus)
  misc_feature (36): n=c or g
cagttggggacctttctacctggtcggcttgggttnttcattcaaaccagctctctgtgatgctcatagct

SEQ ID NO: 48202 - DNA, 71 bp, chicken (Gallus Gallus)
  misc_feature (36): n=c or g
tgtgagactcaaggaaaaaatgctacctaaaacctntcttgattgtagtggctctgagaataatgaaatat

SEQ ID NO: 48203 - DNA, 71 bp, chicken (Gallus Gallus)
  misc_feature (36): n=a or t
cagaacataaagctattgtgaatgcggagtagagtngtttcataaggtagatctcatgagacaaatttcca

SEQ ID NO: 48204 - DNA, 71 bp, chicken (Gallus Gallus)
  misc_feature (36): n=c or g
actaacaaaattttgtataagaatagaccttctaangctcatggaatagacctatccattctatgttacag

SEQ ID NO: 48205 - DNA, 71 bp, chicken (Gallus Gallus)
  misc_feature (36): n=c or g
ttagaaatgcttaattccctgcagactgttcaaagnaacatgaaagccatctccttaacaccgtaccgctc

SEQ ID NO: 48206 - DNA, 71 bp, chicken (Gallus Gallus)
  misc_feature (36): n=c or g
aactgtattaactcactttctgctaatgaggttgtnttaatcgcatgggcataagtgttgctgggtgaagg

SEQ ID NO: 48207 - DNA, 71 bp, chicken (Gallus Gallus)
  misc_feature (36): n=c or g
gggagagctattaccgcactattagctgatttcagnagctgttggggactaacggttctccacaattctgt

SEQ ID NO: 48208 - DNA, 71 bp, chicken (Gallus Gallus)
  misc_feature (36): n=a or t
gccacttctgagtcaggctgttgggtgaattaacancaatacaccatgaaatagcttcctacttaaaacag

SEQ ID NO: 48209 - DNA, 71 bp, chicken (Gallus Gallus)
  misc_feature (36): n=c or g
tcttgggccaattttatgctactcacttgaacttcnaaatgaattatggaaataaattcaagatagaacct

SEQ ID NO: 48210 - DNA, 71 bp, chicken (Gallus Gallus)
  misc_feature (36): n=c or g
tttttttgtttctgtaaagcattttgggattcagtngaaggcaaggtgctgtgcagatgtaagctcgttag

SEQ ID NO: 48211 - DNA, 71 bp, chicken (Gallus Gallus)
  misc_feature (36): n=a or t
caccaccagaaaaaaccactacaccacaggatagtnatttgatttcatagcatcaaagaatagtcaaggtt

SEQ ID NO: 48212 - DNA, 71 bp, chicken (Gallus Gallus)
  misc_feature (36): n=c or g
caacacttatgtcctacactagcaacagtggaaaanatgcagcaagaatgaagccctaagtaaaatacatc

SEQ ID NO: 48213 - DNA, 71 bp, chicken (Gallus Gallus)
  misc_feature (36): n=c or g
agagggctaggaaagaacaacatctcaggaggatgnccctgaacttctggagtgcatcgtgtcgtgatgca

SEQ ID NO: 48214 - DNA, 71 bp, chicken (Gallus Gallus)
  misc_feature (36): n=c or g
agccaaactggaaaagacagatcctgaagtagctgntgaaattaagcagaagatgcagaacaatctacaga

SEQ ID NO: 48215 - DNA, 71 bp, chicken (Gallus Gallus)
  misc_feature (36): n=c or g
gggcatagctgtgcaggcatctcccacctgttcagnagggaatgaccctcacacttcaatcctgaccttgt

SEQ ID NO: 48216 - DNA, 71 bp, chicken (Gallus Gallus)
  misc_feature (36): n=c or g
cattaaaaaatgaatctaagctggtaaaatgcacanacaaaaggaggggtatactacatgagagctaagaa

SEQ ID NO: 48217 - DNA, 71 bp, chicken (Gallus Gallus)
  misc_feature (36): n=a or t
cgatatgaaagcagctataattaggaaggagaatcncacagaagtgtgaggaaaaattctattgccaactt

SEQ ID NO: 48218 - DNA, 71 bp, chicken (Gallus Gallus)
  misc_feature (36): n=c or g
taccacctaactgactattactgtgacaaaatctantccatacacatatatatcacagttaatgccccagt

SEQ ID NO: 48219 - DNA, 71 bp, chicken (Gallus Gallus)
  misc_feature (36): n=c or g
tggtaatcagtgaggtcagatagcttaaggaatcantttaacaagacaacagaaatgaacccctaacttag

SEQ ID NO: 48220 - DNA, 71 bp, chicken (Gallus Gallus)
  misc_feature (36): n=a or t
aacctgcattgtgatgggctgaaagtgaggaaacgnttttccctgcctagtcttagtactgatgaacagac

SEQ ID NO: 48221 - DNA, 71 bp, chicken (Gallus Gallus)
  misc_feature (36): n=a or t
ctggatgaaaatgaaaatacatagttcaaaatccantgatgctcaggtgcacttaagctgagcaagagcac

SEQ ID NO: 48222 - DNA, 71 bp, chicken (Gallus Gallus)
  misc_feature (36): n=a or t
aaatgcacagatacaatgagttaatctcagaggccnttatcaataacttaatattgctacagtttcatatg

SEQ ID NO: 48223 - DNA, 71 bp, chicken (Gallus Gallus)
  misc_feature (36): n=c or g
cccgtccttcactgtgagcaggtgtttgtatcatantgcatattggtgatcaggtcagaaaatcaagtgca

SEQ ID NO: 48224 - DNA, 71 bp, chicken (Gallus Gallus)
  misc_feature (36): n=a or t
cactgcaatgaagtacagagctttttcctcacattnatacattttatattcaaaacacatatttgtacatt

SEQ ID NO: 48225 - DNA, 71 bp, chicken (Gallus Gallus)
  misc_feature (36): n=c or g
tatatttaatgtaatcatcaaatactgtctcaatcntaagtatagatttgcctgttgcttttgtcagactg

SEQ ID NO: 48226 - DNA, 71 bp, chicken (Gallus Gallus)
  misc_feature (36): n=c or g
actaatcagcctgattatgatgtgaggcttctaganataccttgggcttcagcatgttaaaaggagcctgg

SEQ ID NO: 48227 - DNA, 71 bp, chicken (Gallus Gallus)
  misc_feature (36): n=a or t
actctctagacgttcaatacaaataatatttgttgnttcattatatattgtaggtgtggggagttatagct

SEQ ID NO: 48228 - DNA, 71 bp, chicken (Gallus Gallus)
  misc_feature (36): n=c or g
ccatttcttctggccgtgtgtgactgtggggacatntggggatgtgtgtgcccagccctggtgccacagct

SEQ ID NO: 48229 - DNA, 71 bp, chicken (Gallus Gallus)
  misc_feature (36): n=c or g
tacaactgcaggaaatagtatggcatgttacctctntgttctgcattgtcaaaggcatggtcttaaaaaca

SEQ ID NO: 48230 - DNA, 71 bp, chicken (Gallus Gallus)
  misc_feature (36): n=a or t
accattagcctgtccaccagtttgctttgagttgcnctggtatgagagggattaatggaaactgcttgtaa

SEQ ID NO: 48231 - DNA, 71 bp, chicken (Gallus Gallus)
  misc_feature (36): n=a or t
caagagagccattggtgtcagaaaataattgcaatngttaatatacacaacccccggttatcttcttactg

SEQ ID NO: 48232 - DNA, 71 bp, chicken (Gallus Gallus)
  misc_feature (36): n=a or t
ggggcggccaatgccttgggaggtgatatctggganactgacaatgaattctagacactgcaagcacgtgg

SEQ ID NO: 48233 - DNA, 71 bp, chicken (Gallus Gallus)
  misc_feature (36): n=a or t
gcctgtatgaaccagtaggatgcaagccttgcatanactcttaaatctgggaaacagaagactcttcattt

SEQ ID NO: 48234 - DNA, 71 bp, chicken (Gallus Gallus)
  misc_feature (36): n=c or g
agttgaagagcatgaactcaattgcagccctggatnaccagggatcaaggtgccttccttttagtgttgtt

SEQ ID NO: 48235 - DNA, 71 bp, chicken (Gallus Gallus)
  misc_feature (36): n=c or g
gtgcagtagcacagtgacaactaagctggagaacancttcctctctcccctggctgcgtccagagagctgt

SEQ ID NO: 48236 - DNA, 71 bp, chicken (Gallus Gallus)
  misc_feature (36): n=c or g
aattttcaactactttttcagaacctcagatttatngaagagtaaaatgttaacagagatgtttacaagac

SEQ ID NO: 48237 - DNA, 71 bp, chicken (Gallus Gallus)
  misc_feature (36): n=c or g
actcaaaacatagtatgaattacaaaaggaggaaanaatggtgaaacttactggagactgatttaggcatt

SEQ ID NO: 48238 - DNA, 71 bp, chicken (Gallus Gallus)
  misc_feature (36): n=a or t
catgcaatacagaaacaaagatagcatgttatcctnttaagtgaaaccaccaagtcctcagatgaattttt

SEQ ID NO: 48239 - DNA, 71 bp, chicken (Gallus Gallus)
  misc_feature (36): n=c or g
acttcaatccaaagcataataataagcaagctgctntcacagaaagcttaactaggggaggctaaacattt

SEQ ID NO: 48240 - DNA, 71 bp, chicken (Gallus Gallus)
  misc_feature (36): n=c or g
caaataataagtctgagatgggagctcttgcaatgntgatagacatacgcatatagatgagtgacaatatg

SEQ ID NO: 48241 - DNA, 71 bp, chicken (Gallus Gallus)
  misc_feature (36): n=c or g
aaggaactctaggttttaagcaggaaatatctgtgnaagtgttgctttccagacgtccgctctcttctctt

SEQ ID NO: 48242 - DNA, 71 bp, chicken (Gallus Gallus)
  misc_feature (36): n=c or g
aagaaacagaagtttgcaaaagaataatttaaccanagaaaggtaagcaattatgttaaaaatgtctgttg

SEQ ID NO: 48243 - DNA, 71 bp, chicken (Gallus Gallus)
  misc_feature (36): n=c or g
gaacaaattattttcagagacagtaaaatgatagantaaaacagaatctggagcaatatagagaatcacgc

SEQ ID NO: 48244 - DNA, 71 bp, chicken (Gallus Gallus)
  misc_feature (36): n=c or g
ggttgagtagaaatgcagctaaacctgatgcaaaanctgctggtagaaattgagcaatggagaaattactg

SEQ ID NO: 48245 - DNA, 71 bp, chicken (Gallus Gallus)
  misc_feature (36): n=c or g
gagctcagtggtgttgaattgtgccaccaagagacnggatcacgtgcaggagtgatgtcctgctttaaccc

SEQ ID NO: 48246 - DNA, 71 bp, chicken (Gallus Gallus)
  misc_feature (36): n=c or g
gaaaaacagcaaaaagacttcttaaaaacccacaantgcactgacaactttgccagaaactgagaaattcc

SEQ ID NO: 48247 - DNA, 71 bp, chicken (Gallus Gallus)
  misc_feature (36): n=a or t
atgtcagttgcttctttctcatcagctggctgtgtnatggagtcagaaaagaagcttaattccctcgacat

SEQ ID NO: 48248 - DNA, 71 bp, chicken (Gallus Gallus)
  misc_feature (36): n=c or g
cagccctcctctgcctgccaaggagtttaagattancaaccatgaaaatctgtaagagtttatgactgata

SEQ ID NO: 48249 - DNA, 71 bp, chicken (Gallus Gallus)
  misc_feature (36): n=a or t
agccaggaaagagtccagattcttccagctttgcancagcagcaaggctaactttcctcacaacagcagtt

SEQ ID NO: 48250 - DNA, 71 bp, chicken (Gallus Gallus)
  misc_feature (36): n=c or g
ctgaccaagcagagaagactgaagccttaatgcttncatgagctctgcaaggtgagcttggcccttcttgg

SEQ ID NO: 48251 - DNA, 71 bp, chicken (Gallus Gallus)
  misc_feature (36): n=a or t
agattgccacagacctcactctgttgttcagaagtngaaaacttcttctaacctcaaccttacttctgttt

SEQ ID NO: 48252 - DNA, 71 bp, chicken (Gallus Gallus)
  misc_feature (36): n=c or g
gatttccccataatatgctaatctgggttaattggntggctaaccatcatggcggacccaaaggggtgggg

SEQ ID NO: 48253 - DNA, 71 bp, chicken (Gallus Gallus)
  misc_feature (36): n=c or g
aggggggtgaaggaaagagacaccgcactccagaanagacaagaggagggagccctgggctgcaggcacac

SEQ ID NO: 48254 - DNA, 71 bp, chicken (Gallus Gallus)
  misc_feature (36): n=c or g
actttctgagtgattccagaggcttgctttctcatncacagtgtgatatctcacctttgggagcaaagtta

SEQ ID NO: 48255 - DNA, 71 bp, chicken (Gallus Gallus)
  misc_feature (36): n=c or g
tttgaaaaatggttgtgcctggcatgaaaagtgatncttgtgcttagtgtgcactggtgaatattcgtttt

SEQ ID NO: 48256 - DNA, 71 bp, chicken (Gallus Gallus)
  misc_feature (36): n=c or g
ggggggtcctgtgggggatttccaccttaccctggnttgctgtgccaccctcactcacgtactgtttcctc

SEQ ID NO: 48257 - DNA, 71 bp, chicken (Gallus Gallus)
  misc_feature (36): n=a or t
ttacaattcataacattttgcttcatatgaaaaganaatcagatgtagagttcatcgtgcaagcagtggta

SEQ ID NO: 48258 - DNA, 71 bp, chicken (Gallus Gallus)
  misc_feature (36): n=c or g
gtagacattaaaattggctctgatgtcactgttccnactgttgaggaccagaagtttaaagggttgaatgg

SEQ ID NO: 48259 - DNA, 71 bp, chicken (Gallus Gallus)
  misc_feature (36): n=c or g
cggatcttctccttcacctcctccaggtccttggtnagctcagcacgcagagcctcggtgtccttcagcca

SEQ ID NO: 48260 - DNA, 71 bp, chicken (Gallus Gallus)
  misc_feature (36): n=a or t
tgttcccgcattatggcaaagcaattaacttgacantcattagaagcctacctcagccccatgagccagac

SEQ ID NO: 48261 - DNA, 71 bp, chicken (Gallus Gallus)
  misc_feature (36): n=c or g
cacctttatcttcctggtaggcagagtattccactnaaagctggaagcttgctgagcttaggctagaggtt

SEQ ID NO: 48262 - DNA, 71 bp, chicken (Gallus Gallus)
  misc_feature (36): n=c or g
tgtgcagcatgctcattactcaccagagagctccanagctgcctgcgatgggttcctccagagctgcacac

SEQ ID NO: 48263 - DNA, 71 bp, chicken (Gallus Gallus)
  misc_feature (36): n=c or g
ggaagagcgtggctaagcacgagcaggcagtttacntgtctgtaagatgctgacaaataaagttggaggta

SEQ ID NO: 48264 - DNA, 71 bp, chicken (Gallus Gallus)
  misc_feature (36): n=c or g
tgcacaggtactcgataatcttaaggtcaagtttcntagcaagcaaatgggatgggaatagctatacttta

SEQ ID NO: 48265 - DNA, 71 bp, chicken (Gallus Gallus)
  misc_feature (36): n=c or g
catgcgtttcagtgaatcaatcaataaaaataacantgggagaaaacttcccagtaaaatgggccggtgca

SEQ ID NO: 48266 - DNA, 71 bp, chicken (Gallus Gallus)
  misc_feature (36): n=c or g
tgccaggctcattttaagaggtaataaccctatagntatacaaaagtcctttattttctaggaggagattt

SEQ ID NO: 48267 - DNA, 71 bp, chicken (Gallus Gallus)
  misc_feature (36): n=c or g
tcctactaaaaatccatgaataaattgaattgtttncttgtttctaaaaagaatatcaacttgctttgaaa

SEQ ID NO: 48268 - DNA, 71 bp, chicken (Gallus Gallus)
  misc_feature (36): n=a or t
gctgaaatgtaagactacagagaagttcatgagaanttctcagatttgtacaaaatcacactcccttgtgg

SEQ ID NO: 48269 - DNA, 71 bp, chicken (Gallus Gallus)
  misc_feature (36): n=c or g
aattttgggggatgggggagagagcacttctttcantccatcgagatacgcagtttgcctaccaagagtgg

SEQ ID NO: 48270 - DNA, 71 bp, chicken (Gallus Gallus)
  misc_feature (36): n=a or t
ccatcacatttttcatcgttatctctgagagcatcngacaggactgccgagttcaatccatttaacacagc

SEQ ID NO: 48271 - DNA, 71 bp, chicken (Gallus Gallus)
  misc_feature (36): n=c or g
gaccatggacaattattacaacgtgggttcaaatcntgctgaatatctatctccataagccagctttctga

SEQ ID NO: 48272 - DNA, 71 bp, chicken (Gallus Gallus)
  misc_feature (36): n=a or t
acatttttcctaattttcaattatagggagctgagntcaaaatttgaatgcatggaggggaaaaggaaaga

SEQ ID NO: 48273 - DNA, 71 bp, chicken (Gallus Gallus)
  misc_feature (36): n=c or g
tttgatttcccacagactgcattactgagcattaantgggaacagggagtcttattgtcctctttggctta

SEQ ID NO: 48274 - DNA, 71 bp, chicken (Gallus Gallus)
  misc_feature (36): n=a or t
aaactgtagaggacaatgcagcagttagttattacntcttgaattccttctgtacttctatcacaattact

SEQ ID NO: 48275 - DNA, 71 bp, chicken (Gallus Gallus)
  misc_feature (36): n=c or g
aagggacctggagggacgtccccacccctgttggtnacattgaaccccagcgttggcttcactgctgccct

SEQ ID NO: 48276 - DNA, 71 bp, chicken (Gallus Gallus)
  misc_feature (36): n=c or g
gatggagcttgtgggacatatcctgccacaaaccanagctggctggatgcactaagtccagctccttgggc

SEQ ID NO: 48277 - DNA, 71 bp, chicken (Gallus Gallus)
  misc_feature (36): n=a or t
gcaagaatgccaaaaacatgcaaaatgtctcaagtntagaaaataaattggttttggggagaaaagcaggc

SEQ ID NO: 48278 - DNA, 71 bp, chicken (Gallus Gallus)
  misc_feature (36): n=c or g
aatggagccctgattcctttggcagggagctctctncacctgtggtttcctgctcatcccagttagatggg

SEQ ID NO: 48279 - DNA, 71 bp, chicken (Gallus Gallus)
  misc_feature (36): n=a or t
caatactttcaactgcgattcccatgttaaaaaaanagtccagattttcatgtcttcatatgctctcagag

SEQ ID NO: 48280 - DNA, 71 bp, chicken (Gallus Gallus)
  misc_feature (36): n=c or g
attgtcagaatgttgatgctactggttacgtggatntattcccaaaataaacagctcttcaccacccttgt

SEQ ID NO: 48281 - DNA, 71 bp, chicken (Gallus Gallus)
  misc_feature (36): n=a or t
acaaacatgatttggataatggcccagctcaggacncagcagatctctgcactactcagaattcacctctg

SEQ ID NO: 48282 - DNA, 71 bp, chicken (Gallus Gallus)
  misc_feature (36): n=c or g
cttttctccatacataatgaatctaagctgaccttnctagtttccatgcaaacttggggagaaactctcca

SEQ ID NO: 48283 - DNA, 71 bp, chicken (Gallus Gallus)
  misc_feature (36): n=c or g
aaacacctgcctattcaagcagtacagaaacacaanagctcaacaatggtcagaaatcctctggcctgcat

SEQ ID NO: 48284 - DNA, 71 bp, chicken (Gallus Gallus)
  misc_feature (36): n=a or t
atgtgcccaggaactactaaaccgtcagtctcaccnccgtgccagggaatttcatagaacagatcctcctg

SEQ ID NO: 48285 - DNA, 71 bp, chicken (Gallus Gallus)
  misc_feature (36): n=c or g
ggctttcatggcgtggaggtgacatgtttgttctgngaacaaaggcaggagccatctgccgagcgtctgcc

SEQ ID NO: 48286 - DNA, 71 bp, chicken (Gallus Gallus)
  misc_feature (36): n=c or g
caaggctctgacagactggtaggaaagaaatctttntattgtgatgcctttaaaatagctggagggtaaga

SEQ ID NO: 48287 - DNA, 71 bp, chicken (Gallus Gallus)
  misc_feature (36): n=c or g
acccaggttttgccaggtttttgctctggtacagancagctcccttggatggtgaaatcttatggtactta

SEQ ID NO: 48288 - DNA, 71 bp, chicken (Gallus Gallus)
  misc_feature (36): n=c or g
cagtgataagcagggatgaaaaccccagcgctccantaagaaaaccaatgagtttccaaacctggctgata

SEQ ID NO: 48289 - DNA, 71 bp, chicken (Gallus Gallus)
  misc_feature (36): n=c or g
atgctgttgtcaactctacacagatgctgtgggcantatgatcgttctctttcagatctgtaatgcagtag

SEQ ID NO: 48290 - DNA, 71 bp, chicken (Gallus Gallus)
  misc_feature (36): n=a or t
tgtatgtttcatgaaagaatcataggtgcttactgnagttagttttcaagggctgaactcttcagctccat

SEQ ID NO: 48291 - DNA, 71 bp, chicken (Gallus Gallus)
  misc_feature (36): n=a or t
cttgagaacgtaacagacttcacaattcaaaagaantgaatagatcaaaaaaccttggttacttctcttta

SEQ ID NO: 48292 - DNA, 71 bp, chicken (Gallus Gallus)
  misc_feature (36): n=c or g
caagaggagctcctcctgcactagcagagaactctnggactcttcctgaaatacatcaggcattttacata

SEQ ID NO: 48293 - DNA, 71 bp, chicken (Gallus Gallus)
  misc_feature (36): n=a or t
ttctggtaaggtaaagggcatgaggagaaggatacnaacaggacagacagatcaataactggctacaggat

SEQ ID NO: 48294 - DNA, 71 bp, chicken (Gallus Gallus)
  misc_feature (36): n=c or g
tggtaaaaagtaatgagagattacatttgcatccanaggatctgacaaataggacagaatcctgcaacata

SEQ ID NO: 48295 - DNA, 71 bp, chicken (Gallus Gallus)
  misc_feature (36): n=a or t
gatggttaaagctttgaattcttccgcaataagaangactaggacttaagtaaatatagttatagctgtca

SEQ ID NO: 48296 - DNA, 71 bp, chicken (Gallus Gallus)
  misc_feature (36): n=c or g
ctgcacactattagactccctcgtctcttctgaggntcctaaattgctacagaaagtggtattgttttctg

SEQ ID NO: 48297 - DNA, 71 bp, chicken (Gallus Gallus)
  misc_feature (36): n=c or g
tgtggaacacagcaggatacagcttggacctagagncctcttggcctcatgatacaggctgtgttcaggtg

SEQ ID NO: 48298 - DNA, 71 bp, chicken (Gallus Gallus)
  misc_feature (36): n=a or t
atggcctgataattccatgtgggttgaggatggtcntggtacactgtaattttcggggaacaagagtaaca

SEQ ID NO: 48299 - DNA, 71 bp, chicken (Gallus Gallus)
  misc_feature (36): n=c or g
ccaaagtgacaggggaggaggatggcacaggcagcnctgtgagctgctcagctttgtgctgggacgatgga

SEQ ID NO: 48300 - DNA, 71 bp, chicken (Gallus Gallus)
  misc_feature (36): n=c or g
cctccaaagctctgtgcctgtaggccttcagattanagagctgttcagctctttgcattccctaaaccaac

SEQ ID NO: 48301 - DNA, 71 bp, chicken (Gallus Gallus)
  misc_feature (36): n=a or t
tacaagataggaactaatgctaggggcggatccagnactgcacacaggtacctgctgatttgccaagttgt

SEQ ID NO: 48302 - DNA, 71 bp, chicken (Gallus Gallus)
  misc_feature (36): n=a or t
ggtaaccttcccttcaaatccacagatatcaactcnatattctacatcacagcacataaaacacggtgcgt

SEQ ID NO: 48303 - DNA, 71 bp, chicken (Gallus Gallus)
  misc_feature (36): n=a or t
agctctctgaaatgggtacctgctgtgaagagcacntgtaaagtagtttaaaaggtagttatacaaactaa

SEQ ID NO: 48304 - DNA, 71 bp, chicken (Gallus Gallus)
  misc_feature (36): n=c or g
caaattgtagccataaagatacgcaaaatgaagaantaaaagtgctgttgtccattttctgaggttcataa

SEQ ID NO: 48305 - DNA, 71 bp, chicken (Gallus Gallus)
  misc_feature (36): n=c or g
gtatgccttcagcagatggtaaatccaagccttagngttttttaacaggcgaatataggaagagaacagtt

SEQ ID NO: 48306 - DNA, 71 bp, chicken (Gallus Gallus)
  misc_feature (36): n=c or g
taaaccaggaaaagaacaagctgccattctctgtanctcaaattagatctgacaagaccactcttcttact

SEQ ID NO: 48307 - DNA, 71 bp, chicken (Gallus Gallus)
  misc_feature (36): n=a or t
gagtgagattgcaaggaatagagatgcacaagtgcnttaaaagaacaacatcccagcaaaattactttata

SEQ ID NO: 48308 - DNA, 71 bp, chicken (Gallus Gallus)
  misc_feature (36): n=c or g
agtgctttctctctctttttagaggagaaccatagnaataactcaaagtcatatattgcttctgtcttcta

SEQ ID NO: 48309 - DNA, 71 bp, chicken (Gallus Gallus)
  misc_feature (36): n=a or t
tgattggtattgtctctgattaccccttttgtgttntgtagtgaactgtatagtaaaggacattctgtgct

SEQ ID NO: 48310 - DNA, 71 bp, chicken (Gallus Gallus)
  misc_feature (36): n=a or t
gaggttgttaactcagtttcccaatgcagagaaaangaagacaacatctccaccgggtgacgagatcaaaa

SEQ ID NO: 48311 - DNA, 71 bp, chicken (Gallus Gallus)
  misc_feature (36): n=a or t
ctccaaccacttcagtatccctgctcaagacttctnactggcccacgtacttcttgaaacagttgtggcac

SEQ ID NO: 48312 - DNA, 71 bp, chicken (Gallus Gallus)
  misc_feature (36): n=c or g
aaataaatgctccctgctttatctacctttctacantcttcacctggagatggactaaagcagtatgatgg

SEQ ID NO: 48313 - DNA, 71 bp, chicken (Gallus Gallus)
  misc_feature (36): n=c or g
cacagagggtgccggtggggccagggcagagaaatntgagagacttcgatcttcctgcacgacaaaatagg

SEQ ID NO: 48314 - DNA, 71 bp, chicken (Gallus Gallus)
  misc_feature (36): n=c or g
gttgtgtacaaggaataagtgaaacttggcattcanatgcttgggagcatcagtttctgtgttcagctgag

SEQ ID NO: 48315 - DNA, 71 bp, chicken (Gallus Gallus)
  misc_feature (36): n=c or g
cagttgttccctacttccatgtcagctcagggagantccattgtgtgattcgaagttgctccaaataaagc

SEQ ID NO: 48316 - DNA, 71 bp, chicken (Gallus Gallus)
  misc_feature (36): n=c or g
accctgagagcaggtagtataaatataccgacaatnattcagaaatgcgcctgagacattagaggaggaag

SEQ ID NO: 48317 - DNA, 71 bp, chicken (Gallus Gallus)
  misc_feature (36): n=c or g
gtaggttgcatatttacagtagattctcatatttcntatgaaaactttcttattcctatatgaaatctggc

SEQ ID NO: 48318 - DNA, 71 bp, chicken (Gallus Gallus)
  misc_feature (36): n=c or g
ttcaagtagtatgcatccccttttgcccattatttnttatacaaatgcctataatattacgtttatatatt

SEQ ID NO: 48319 - DNA, 71 bp, chicken (Gallus Gallus)
  misc_feature (36): n=c or g
tgatcctctcccaacactcggagccgctgagcccanttgccaactcccgggtcagactgtctcctgcaagg

SEQ ID NO: 48320 - DNA, 71 bp, chicken (Gallus Gallus)
  misc_feature (36): n=c or g
aggtaaggagttttgtattagtattttactgttttnaacacacctgtagcaacaacatatcttacaggaat

SEQ ID NO: 48321 - DNA, 71 bp, chicken (Gallus Gallus)
  misc_feature (36): n=c or g
catccaaggccaagaaaggagcacttcagggcaagnccagtccaaggcaaacccctgttcaaacaccagcc

SEQ ID NO: 48322 - DNA, 71 bp, chicken (Gallus Gallus)
  misc_feature (36): n=a or t
gtcccttaagttgctgcaatgaagaacataaccaanataatatcatgcaatagccattcctcttcatccct

SEQ ID NO: 48323 - DNA, 71 bp, chicken (Gallus Gallus)
  misc_feature (36): n=a or t
ttcctgtcttgctctgcttttactcttctccatgantcatgatgactgtgtcatttttcattgtataaaga

SEQ ID NO: 48324 - DNA, 71 bp, chicken (Gallus Gallus)
  misc_feature (36): n=c or g
ccaacagacatgctaatttcccgatccctactactncccacagatagacgaccttggcttttcaaaccact

SEQ ID NO: 48325 - DNA, 71 bp, chicken (Gallus Gallus)
  misc_feature (36): n=c or g
cacactcacccttcacatggatgtgtaaatcctgancttatatctgtggaatatccttgttgatggtgttc

SEQ ID NO: 48326 - DNA, 71 bp, chicken (Gallus Gallus)
  misc_feature (36): n=c or g
tttctgcagccctgtggggtctataatgcacaacanaatggtggcctcatttctgcaggaataagagaaga

SEQ ID NO: 48327 - DNA, 71 bp, chicken (Gallus Gallus)
  misc_feature (36): n=c or g
ttcctgataagctgaccagaacgagctttctgaacntgtcttgctgaggctttctcatcacccttcagata

SEQ ID NO: 48328 - DNA, 71 bp, chicken (Gallus Gallus)
  misc_feature (36): n=a or t
gaaattgcacctgaaggagatatcaacctgatgtcntttggtagcttgagccccccagcaaacagaaatgc

SEQ ID NO: 48329 - DNA, 71 bp, chicken (Gallus Gallus)
  misc_feature (36): n=a or t
atgtgcaacgacagccacctctgtaccaaggcttgnaaaagaccaggaatcctacaaaccaaccaacaacc

SEQ ID NO: 48330 - DNA, 71 bp, chicken (Gallus Gallus)
  misc_feature (36): n=c or g
aaagtagatgagtggtgcctcctctctgcttcagancaggacatgcacccctccaggcacaggctgatgtt

SEQ ID NO: 48331 - DNA, 71 bp, chicken (Gallus Gallus)
  misc_feature (36): n=a or t
aatattgcttaaaagcgtgatcagtctggtagttcngagtgtgaggtgtgtgtgtcggctgataaaatcca

SEQ ID NO: 48332 - DNA, 71 bp, chicken (Gallus Gallus)
  misc_feature (36): n=a or t
tgcagcttcctaagcaaagcggaatacaccttcgcngtgcatatttctgtaagaagagagaaaaatccaat

SEQ ID NO: 48333 - DNA, 71 bp, chicken (Gallus Gallus)
  misc_feature (36): n=c or g
tttgctgacattgaatttaatctgccattttttaantgttcagtcggtgtcatgagactattcatttatac

SEQ ID NO: 48334 - DNA, 71 bp, chicken (Gallus Gallus)
  misc_feature (36): n=c or g
aaatatatcgtgtacagtgagcacagaagagagaangctgcttaatatttctaatctgctacacactttat

SEQ ID NO: 48335 - DNA, 71 bp, chicken (Gallus Gallus)
  misc_feature (36): n=c or g
tggaggagatgcatgacaggggtgccttctctaccncttctacccctttctccctgattctccagttcatc

SEQ ID NO: 48336 - DNA, 71 bp, chicken (Gallus Gallus)
  misc_feature (36): n=c or g
aacacctggtagaactaccttattgcagatttaagncagattcatcacgttattggggctacaggaaccaa

SEQ ID NO: 48337 - DNA, 71 bp, chicken (Gallus Gallus)
  misc_feature (36): n=a or t
aactttagactcaacatatctgattacaagagtagnatggatgctagatatgtatgatcaatgcttctctc

SEQ ID NO: 48338 - DNA, 71 bp, chicken (Gallus Gallus)
  misc_feature (36): n=c or g
ttacgggactttgattataatctgtcactttgcatnattttgaatgcttgtatgcataatgagggcaataa

SEQ ID NO: 48339 - DNA, 71 bp, chicken (Gallus Gallus)
  misc_feature (36): n=c or g
gtgtatattaaatgtatgccttaattttgaaagaanagaaagcaagaatatcctatacttggtctaagcat

SEQ ID NO: 48340 - DNA, 71 bp, chicken (Gallus Gallus)
  misc_feature (36): n=c or g
ctttcagtcagatatggaagtatataggagaagacnagaagttatgatctaatcacacatttctgcattta

SEQ ID NO: 48341 - DNA, 71 bp, chicken (Gallus Gallus)
  misc_feature (36): n=c or g
tttccagtgtgctaactagcatgcttgaagttctantctaaagcagagttccccatattcagggaagtagc

SEQ ID NO: 48342 - DNA, 71 bp, chicken (Gallus Gallus)
  misc_feature (36): n=a or t
caatttgagaatcttgtacctgatagttttcaaagnggtatatggagagctggagaaagacttagcacttc

SEQ ID NO: 48343 - DNA, 71 bp, chicken (Gallus Gallus)
  misc_feature (36): n=a or t
tctgagatctgcctcataggactgacctgttctggnagtagttttgtcattaactagtttttccaggctac

SEQ ID NO: 48344 - DNA, 71 bp, chicken (Gallus Gallus)
  misc_feature (36): n=c or g
caaagatagttggtatcactgcgactttctttcagnccatacagacgtgaaaggaactcccaactgtagtg

SEQ ID NO: 48345 - DNA, 71 bp, chicken (Gallus Gallus)
  misc_feature (36): n=c or g
cacctctcaaatcatcagcactgatgtcatgaatgncaaagcgatgcaattaagtgctgctgtcgtttcaa

SEQ ID NO: 48346 - DNA, 71 bp, chicken (Gallus Gallus)
  misc_feature (36): n=a or t
gctttggcagtggctgttccccagccttggtggcanaagtagacagacggatgggggaagggattgttttg

SEQ ID NO: 48347 - DNA, 71 bp, chicken (Gallus Gallus)
  misc_feature (36): n=a or t
cccctgcatgaatttaagcttatagagtaaaccacnattgtcatggcaataatagcaatcagggagcaaag

SEQ ID NO: 48348 - DNA, 71 bp, chicken (Gallus Gallus)
  misc_feature (36): n=a or t
ctacctaataaatactccagcagcaatgtagacganttttaacagagtgtctttctggtcctattcatgct

SEQ ID NO: 48349 - DNA, 71 bp, chicken (Gallus Gallus)
  misc_feature (36): n=a or t
caaatacacaaaatcaaatctttcttctcaaaatcnctgcatgctatgctgcataaatctgccttcaggct

SEQ ID NO: 48350 - DNA, 71 bp, chicken (Gallus Gallus)
  misc_feature (36): n=a or t
ttccagatgcttaatagtttaaagcacaagactgtntgaactcttgctgggttcacttgattgcacagctt

SEQ ID NO: 48351 - DNA, 71 bp, chicken (Gallus Gallus)
  misc_feature (36): n=a or t
ttcgtgtacatctcctgcgcggccgctattcttccnaactgggaaaccaggctggattttcaggaagcctt

SEQ ID NO: 48352 - DNA, 71 bp, chicken (Gallus Gallus)
  misc_feature (36): n=a or t
aggcaaagacagtaccttgtctctgatgttctctcnctggcataaccagaaaagatgacaaatgtaggcat

SEQ ID NO: 48353 - DNA, 71 bp, chicken (Gallus Gallus)
  misc_feature (36): n=a or t
caaagtgatacataaatgataactgtgagatccatnggactggtcgtggtcgtgatcccagactgctgggc

SEQ ID NO: 48354 - DNA, 71 bp, chicken (Gallus Gallus)
  misc_feature (36): n=a or t
atggtgtggtggctgtccatatcaaactcctgtatngtcatgaaacagctagccatctgtcctgctccttc

SEQ ID NO: 48355 - DNA, 71 bp, chicken (Gallus Gallus)
  misc_feature (36): n=a or t
cttatgctatataaagtatatgatcttagcagaaanggtcaaaccatcatccttacatttttattcacatg

SEQ ID NO: 48356 - DNA, 71 bp, chicken (Gallus Gallus)
  misc_feature (36): n=c or g
ggttaaaaatgtgtcactgctttttcaaattggccnttctctgctttaagcccgacgcaggcttcagagaa

SEQ ID NO: 48357 - DNA, 71 bp, chicken (Gallus Gallus)
  misc_feature (36): n=a or t
acttctgctgttttccatcaatgcattatttgccangttgaaatctttccccttttgccacttttccttcc

SEQ ID NO: 48358 - DNA, 71 bp, chicken (Gallus Gallus)
  misc_feature (36): n=a or t
agggaaggaccatggaaaagtctcagtttttgactnaaacactggcagctttgctttggagctcatggggc

SEQ ID NO: 48359 - DNA, 71 bp, chicken (Gallus Gallus)
  misc_feature (36): n=c or g
gcctgttgctgggggtagttctacatgtattttggntaccatcactatgtgagagaactctcatctgctgc

SEQ ID NO: 48360 - DNA, 71 bp, chicken (Gallus Gallus)
  misc_feature (36): n=c or g
tgataatacttcctaaagataaaaacttcaggccanggaagcaggattccgtaaggcactattcaatggca

SEQ ID NO: 48361 - DNA, 71 bp, chicken (Gallus Gallus)
  misc_feature (36): n=a or t
tgtggtcttatgacagttactattgcatataagtcngatgtctgtaaataagatctgttcaaagatagttc

SEQ ID NO: 48362 - DNA, 71 bp, chicken (Gallus Gallus)
  misc_feature (36): n=c or g
tagagtctccaacattttgaggactgcacaggtctnaaaggtggggactccccccacagcccattgctatg

SEQ ID NO: 48363 - DNA, 71 bp, chicken (Gallus Gallus)
  misc_feature (36): n=a or t
tgctgcttttgaagctggtaggtgtcactctggaangtgcggctgtgctgacctggcactgctcagcactg

SEQ ID NO: 48364 - DNA, 71 bp, chicken (Gallus Gallus)
  misc_feature (36): n=c or g
aacacagacccatgccagaaacagacaatctgacantactggaattagacacaaataaaaacttcttatga

SEQ ID NO: 48365 - DNA, 71 bp, chicken (Gallus Gallus)
  misc_feature (36): n=c or g
attgaagcgggttttaatcaagccgcaggctttggnatcacaaatcctcagaagtcaagcgtgcaattacc

SEQ ID NO: 48366 - DNA, 71 bp, chicken (Gallus Gallus)
  misc_feature (36): n=a or t
gagtgtccaaatctgcacaagggacacagcctgccngcactgtggatcttcatgggtttttggttttgtga

SEQ ID NO: 48367 - DNA, 71 bp, chicken (Gallus Gallus)
  misc_feature (36): n=c or g
tttctactgcactactgtggtgtggtgcacaaacantagggatgaaaatcatcctacagaggattcaagga

SEQ ID NO: 48368 - DNA, 71 bp, chicken (Gallus Gallus)
  misc_feature (36): n=c or g
agtttgtgtggtctcctgacagtgacattgagtttnagagtgggagaggaaaagtgacagaaagggaaaag

SEQ ID NO: 48369 - DNA, 71 bp, chicken (Gallus Gallus)
  misc_feature (36): n=c or g
gtagaaattgcagtttcttactaaaggggaaaaganggactgtattactgaccaatgacctacctggtctg

SEQ ID NO: 48370 - DNA, 71 bp, chicken (Gallus Gallus)
  misc_feature (36): n=a or t
actaaagaaactcatgttttgcttggcagacttctncagtttgtctgggggtggttgctttttgcctccaa

SEQ ID NO: 48371 - DNA, 71 bp, chicken (Gallus Gallus)
  misc_feature (36): n=a or t
cttgctgtgcattttacttgtgcatataaatcttgntttttattctctaacttcttctattctttgttttc

SEQ ID NO: 48372 - DNA, 71 bp, chicken (Gallus Gallus)
  misc_feature (36): n=c or g
attttgcaatcaaaccagcaagaacttgaagaacangtttattgtatctgcaggtgtcaggtatcataaaa

SEQ ID NO: 48373 - DNA, 71 bp, chicken (Gallus Gallus)
  misc_feature (36): n=a or t
gataagaatcacattaagtcagctatgacagtaatnacgtgaagagttgttagccatacagctcagtgcca

SEQ ID NO: 48374 - DNA, 71 bp, chicken (Gallus Gallus)
  misc_feature (36): n=c or g
gggagactttttgcaacaacacagcgttgcaaacantgtgcttgctctaaaataaagatctgattgcatgg

SEQ ID NO: 48375 - DNA, 71 bp, chicken (Gallus Gallus)
  misc_feature (36): n=c or g
acagctctgggttgcaagtgggctgtgtaagttctnatgcttgattacgtgggttggactgtgggatagaa

SEQ ID NO: 48376 - DNA, 71 bp, chicken (Gallus Gallus)
  misc_feature (36): n=c or g
ttagcagttgccctaagatagaaagaaagcctttcngtctccttagaaaagcaacttcagagggaacacag

SEQ ID NO: 48377 - DNA, 71 bp, chicken (Gallus Gallus)
  misc_feature (36): n=c or g
ctttttcttccaagccacagacctgcttcacaaggnatatctgtttgcaacgaagtttgatttagtttctc

SEQ ID NO: 48378 - DNA, 71 bp, chicken (Gallus Gallus)
  misc_feature (36): n=c or g
tcttcgattagaaactcgatctgtcaccctgtctantagagcaaggaaaaccagcaggttgcaagtagaca

SEQ ID NO: 48379 - DNA, 71 bp, chicken (Gallus Gallus)
  misc_feature (36): n=c or g
tcacccattagttaggattcacaacattgcaggacncacagcaggccatcaagctgaacttctgtgattga

SEQ ID NO: 48380 - DNA, 71 bp, chicken (Gallus Gallus)
  misc_feature (36): n=c or g
gggcgggtgaaagttaagagttttcaaggagcaganagtaacactaaaaatctccatcaataagcagggcc

SEQ ID NO: 48381 - DNA, 71 bp, chicken (Gallus Gallus)
  misc_feature (36): n=c or g
caaatgaaaatgagcagtggaaccaaaaccttgaanaagatgatttgtttcaatatcaagcttgttggggt

SEQ ID NO: 48382 - DNA, 71 bp, chicken (Gallus Gallus)
  misc_feature (36): n=c or g
ctgattttatcagtattccatataatggcatcatgnagcaaaccgtttagtactggaacacagtgctgggg

SEQ ID NO: 48383 - DNA, 71 bp, chicken (Gallus Gallus)
  misc_feature (36): n=c or g
tgcaggttgagagctgtggataattggagcccactntcagatgagtgatgttctgcctgttctttgtcaaa

SEQ ID NO: 48384 - DNA, 71 bp, chicken (Gallus Gallus)
  misc_feature (36): n=a or t
cattctcagcatcttacagagacttaagactttcangcactttcccaccctgatgatgttctaaaagataa

SEQ ID NO: 48385 - DNA, 71 bp, chicken (Gallus Gallus)
  misc_feature (36): n=c or g
aaagtggtgtaagtgctgtgccagttttgtccccantggtgacaacactgaaaaaaagatagcttttatcc

SEQ ID NO: 48386 - DNA, 71 bp, chicken (Gallus Gallus)
  misc_feature (36): n=a or t
tggggtaggagaaccgggtaactgtgcctgctaacngcggtccgtggcactctctcagtatgatattcagg

SEQ ID NO: 48387 - DNA, 71 bp, chicken (Gallus Gallus)
  misc_feature (36): n=c or g
atcctctggaagtaaggctacttgacatttgagtantagaccttcagtttaaatagtaccctgcaaggtaa

SEQ ID NO: 48388 - DNA, 71 bp, chicken (Gallus Gallus)
  misc_feature (36): n=c or g
ggaggtccagatgccttttaagtatgaaagcataantgtggctttgatacactgacccacatatagataac

SEQ ID NO: 48389 - DNA, 71 bp, chicken (Gallus Gallus)
  misc_feature (36): n=a or t
caccctcaacagcagttgcacaagaatgctatttcncttactgtttgtgcactgtgagcaactgctatctt

SEQ ID NO: 48390 - DNA, 71 bp, chicken (Gallus Gallus)
  misc_feature (36): n=c or g
tagggccacaaggaaggggaaggtgcaagccagagnctgattccaaaagcagcgtgctttctttttcatgc

SEQ ID NO: 48391 - DNA, 71 bp, chicken (Gallus Gallus)
  misc_feature (36): n=a or t
tgctgtactagttaaagtggttataattagagatanaatctagagtacttaaccattaattcctgtaattt

SEQ ID NO: 48392 - DNA, 71 bp, chicken (Gallus Gallus)
  misc_feature (36): n=c or g
ttccacagtttagtgaggccaagtggggacaacttntaggagaaagtttctcctagtactaagtgattatg

SEQ ID NO: 48393 - DNA, 71 bp, chicken (Gallus Gallus)
  misc_feature (36): n=a or t
ggtaaactgaccaatcatttttaaagacaataacancttatttatgtaacacctaaacaaagttctgtgtg

SEQ ID NO: 48394 - DNA, 71 bp, chicken (Gallus Gallus)
  misc_feature (36): n=c or g
aatggggcatcccgtccaccgatgacatttgcactntggtgagcagggtcaggttagtctgtttactccca

SEQ ID NO: 48395 - DNA, 71 bp, chicken (Gallus Gallus)
  misc_feature (36): n=a or t
agaacacgaaggcaatgtggcaataagccctggcanttaacttcctgttcttctgaggagaacagcggtgc

SEQ ID NO: 48396 - DNA, 71 bp, chicken (Gallus Gallus)
  misc_feature (36): n=a or t
gtgcaatttgagaccacttccttcacactcaacccnaagcttttcttttgtgccttcctattatcataccg

SEQ ID NO: 48397 - DNA, 71 bp, chicken (Gallus Gallus)
  misc_feature (36): n=a or t
ggggttgccttccaattctagtctttgatttttatntctttgacactctaattttatgttatactacttaa

SEQ ID NO: 48398 - DNA, 71 bp, chicken (Gallus Gallus)
  misc_feature (36): n=c or g
ccagagtagcagttctgcagagggcgcagttcaganacccctcagatgtagcattagcatattcctactct

SEQ ID NO: 48399 - DNA, 71 bp, chicken (Gallus Gallus)
  misc_feature (36): n=a or t
atgtaaatgaataagataataaattaaacccagaanaactgttcctaacttggatcttagaaacttgtatt

SEQ ID NO: 48400 - DNA, 71 bp, chicken (Gallus Gallus)
  misc_feature (36): n=c or g
cagaaaatacattgtgctggaggtactcacaatctntctcttcaggcatccaatttagatgcctccgctgg

SEQ ID NO: 48401 - DNA, 71 bp, chicken (Gallus Gallus)
  misc_feature (36): n=a or t
ccactaaaataggaaagtaacttagtttaattgttncccattctaattcttattaggtagaggtctttctt

SEQ ID NO: 48402 - DNA, 71 bp, chicken (Gallus Gallus)
  misc_feature (36): n=a or t
actgcaaaaacacactaattggaaagacaggattgngcatgtcttgcagaatgctgagagtgaatgtttca

SEQ ID NO: 48403 - DNA, 71 bp, chicken (Gallus Gallus)
  misc_feature (36): n=c or g
aggtgtcaactaaaacgttactgattttatcaaatnaaaatggatccctgttccctactgactgtcatggt

SEQ ID NO: 48404 - DNA, 71 bp, chicken (Gallus Gallus)
  misc_feature (36): n=a or t
tacgttataaaattttaacataatgcacacgtatantaaaccataataaataagattggtttcactaagtt

SEQ ID NO: 48405 - DNA, 71 bp, chicken (Gallus Gallus)
  misc_feature (36): n=c or g
gacaggaaacatatttgtttgtattaacaaggaatntggctctttaataatgtggcagataacttataact

SEQ ID NO: 48406 - DNA, 71 bp, chicken (Gallus Gallus)
  misc_feature (36): n=c or g
atctacagctaatcacatcaagatgtcaacaagatntttaaatcaaggcagaaaagaagtctagtcaatct

SEQ ID NO: 48407 - DNA, 71 bp, chicken (Gallus Gallus)
  misc_feature (36): n=c or g
tttaataaaataacctaaatttcacacagaacttantgctgcaaaacaggatggataagtatacttcacac

SEQ ID NO: 48408 - DNA, 71 bp, chicken (Gallus Gallus)
  misc_feature (36): n=c or g
tgcccgcaaggatgacgtatcagaaagaagcctatntattttttcattgtttttatgatcttaggatatgt

SEQ ID NO: 48409 - DNA, 71 bp, chicken (Gallus Gallus)
  misc_feature (36): n=a or t
tgcctgcccaccttcctctttgtgagcaggaagtanaaactgaaccttgtcatcagtctccatttaaaata

SEQ ID NO: 48410 - DNA, 71 bp, chicken (Gallus Gallus)
  misc_feature (36): n=c or g
cagtgtagggattggattgaccacagagccaagatncacagctttcttggcgatggatggagcccttaaat

SEQ ID NO: 48411 - DNA, 71 bp, chicken (Gallus Gallus)
  misc_feature (36): n=c or g
ccctctactttgaccaactgtgtaaggcagccaaanttgtagggaaatggagaaagaaatatcatagcttt

SEQ ID NO: 48412 - DNA, 71 bp, chicken (Gallus Gallus)
  misc_feature (36): n=c or g
gtctaagagaacaacatgctggcaaagcaggatttntgataagcctttttatgtttggtttcttattcctt

SEQ ID NO: 48413 - DNA, 71 bp, chicken (Gallus Gallus)
  misc_feature (36): n=c or g
tgtggggcaaagttattgcgagcattctgaaagttntcagtgaaaaagtactttaaatctccacagtgttt

SEQ ID NO: 48414 - DNA, 71 bp, chicken (Gallus Gallus)
  misc_feature (36): n=c or g
ttttccctaaagaactgggtttttcctaataatttnaggcaggatataccaaatgatacatgtgttcatac

SEQ ID NO: 48415 - DNA, 71 bp, chicken (Gallus Gallus)
  misc_feature (36): n=a or t
acagagggctggcacttaaattgttatacttgcagngttaagctttaggcatgagtgtgatagaccttaaa

SEQ ID NO: 48416 - DNA, 71 bp, chicken (Gallus Gallus)
  misc_feature (36): n=c or g
ttactatcctgatttgtttgtgctaaagagcgctgnggtcttgagagtggccatgtccagtttattctatc

SEQ ID NO: 48417 - DNA, 71 bp, chicken (Gallus Gallus)
  misc_feature (36): n=c or g
catgagaacatttcttcactataatcacattgttantggatgttctctgaaatttaataaaggccaatatc

SEQ ID NO: 48418 - DNA, 71 bp, chicken (Gallus Gallus)
  misc_feature (36): n=a or t
tagctagagaatatcttcagaccttgaaagtttcanagtcactgatccaaaatatggaggctgcctgatct

SEQ ID NO: 48419 - DNA, 71 bp, chicken (Gallus Gallus)
  misc_feature (36): n=c or g
tggttgcagctattgtggtttacagtgtacaaagcnatgtgacacctccgtgttgtcacaagtgagtttgg

SEQ ID NO: 48420 - DNA, 71 bp, chicken (Gallus Gallus)
  misc_feature (36): n=c or g
tttttgctccattttatgtgctgtgatagctgaganactgagtttgtcggtgtcctgcttttctgttgctg

SEQ ID NO: 48421 - DNA, 71 bp, chicken (Gallus Gallus)
  misc_feature (36): n=c or g
cagcctgtttcacagaagctgtggtagaagcattgntagaaatcccttcccctgtctctcaccaagtgtgg

SEQ ID NO: 48422 - DNA, 71 bp, chicken (Gallus Gallus)
  misc_feature (36): n=a or t
tggaggagtggtgctgggggacctgtctccttgagnagctgacagatgtaggagagtttaaagcctccttg

SEQ ID NO: 48423 - DNA, 71 bp, chicken (Gallus Gallus)
  misc_feature (36): n=c or g
atctggaattctagacctctgcaaggtgcagaatgntctatttcagtttgggcccatatattgcataccgg

SEQ ID NO: 48424 - DNA, 71 bp, chicken (Gallus Gallus)
  misc_feature (36): n=a or t
tttttcatgccgaattcctctctttagacccctaanctgatacaccaaccccttcctcatggcccttgcag

SEQ ID NO: 48425 - DNA, 71 bp, chicken (Gallus Gallus)
  misc_feature (36): n=c or g
catgggttcttaacatgctggaagagttccccttgntttcttatcaggctcatatccaacccttttaacaa

SEQ ID NO: 48426 - DNA, 71 bp, chicken (Gallus Gallus)
  misc_feature (36): n=a or t
tgagctgctgtgttgagttccaatgtcacataaatngtcagaactttgctgtttcttcccccatccccccc

SEQ ID NO: 48427 - DNA, 71 bp, chicken (Gallus Gallus)
  misc_feature (36): n=c or g
tttgcctttcctactgatagaaccacatactcagcntggtcaatggtgggatcctcctctgtatgaacaaa

SEQ ID NO: 48428 - DNA, 71 bp, chicken (Gallus Gallus)
  misc_feature (36): n=a or t
cttctgatgttaccaaagtattttagtcctgtgagngattttcaataaccagtatttcatacatgtcaggt

SEQ ID NO: 48429 - DNA, 71 bp, chicken (Gallus Gallus)
  misc_feature (36): n=a or t
actctcagttggcctccacttcaagtttaaaacaanttttttgttcactctgaggtcatcctgagggcctc

SEQ ID NO: 48430 - DNA, 71 bp, chicken (Gallus Gallus)
  misc_feature (36): n=c or g
actgggagtttcaaaaggattctgtgcagcaaaaanaaaggactttaccccagtgtccatttttgcagact

SEQ ID NO: 48431 - DNA, 71 bp, chicken (Gallus Gallus)
  misc_feature (36): n=c or g
gtattaacaaataaatctgtagatttcagtctactntaggaaaatgtttaatcttgcttgacactttacac

SEQ ID NO: 48432 - DNA, 71 bp, chicken (Gallus Gallus)
  misc_feature (36): n=a or t
gctgctatcaacttctttggtttggacatttttaangtcttactttgcctttccacttctggacatgaaac

SEQ ID NO: 48433 - DNA, 71 bp, chicken (Gallus Gallus)
  misc_feature (36): n=c or g
ctgtctgctaaagcagtgaatggttgtactgaacanaaacatgttgaaactataccgtataaagatgctac

SEQ ID NO: 48434 - DNA, 71 bp, chicken (Gallus Gallus)
  misc_feature (36): n=a or t
aattgggccacagaaactggaaaattttattcaacntacacttatactgtattaggacctacttgttccag

SEQ ID NO: 48435 - DNA, 71 bp, chicken (Gallus Gallus)
  misc_feature (36): n=a or t
ttgttgccaatgtgtagttcatattactatagcttnctgacgtggtatcttactctgctcttgaaaagaca

SEQ ID NO: 48436 - DNA, 71 bp, chicken (Gallus Gallus)
  misc_feature (36): n=c or g
aggacttctgagataagatttataattttcagtcanttgggatgatactggcaaagaatgttgttgagttt

SEQ ID NO: 48437 - DNA, 71 bp, chicken (Gallus Gallus)
  misc_feature (36): n=c or g
gaatttctcagtcatcatcttggatttcattgtccntttcttcacctggctattagtaactctcaagtgag

SEQ ID NO: 48438 - DNA, 71 bp, chicken (Gallus Gallus)
  misc_feature (36): n=a or t
ctagccatgctaccgtgcttctttgttaataacaangagtagtattattgtcccagcatactggaaaagct

SEQ ID NO: 48439 - DNA, 71 bp, chicken (Gallus Gallus)
  misc_feature (36): n=a or t
ggagatgaatgtggagttgctattctccctagtacnttggctttcaatctgcacagaccctcttccaccat

SEQ ID NO: 48440 - DNA, 71 bp, chicken (Gallus Gallus)
  misc_feature (36): n=c or g
caggaagctttcacaggagcaaacctcctcactganagtacattgctagagtgctctggggtgactggcag

SEQ ID NO: 48441 - DNA, 71 bp, chicken (Gallus Gallus)
  misc_feature (36): n=a or t
tgcataaaatgaatgcatagaagcagcagcaaatanaacctatatcttttcagaaaccaagcaatgttact

SEQ ID NO: 48442 - DNA, 71 bp, chicken (Gallus Gallus)
  misc_feature (36): n=c or g
gaaacaacacatgaatgttaatttgatttgtgcttnagcaagaaactgttgacagaagatgccgtggggtt

SEQ ID NO: 48443 - DNA, 71 bp, chicken (Gallus Gallus)
  misc_feature (36): n=c or g
aagactatttattgtgtgccctgtgaagaaagagcngtggctgcacagaccaagacgacacaagtattcag

SEQ ID NO: 48444 - DNA, 71 bp, chicken (Gallus Gallus)
  misc_feature (36): n=a or t
gactggatgtatttggtgctactatttgacctttcngaactgaaatgaacaaagtgcccattcagtcttta

SEQ ID NO: 48445 - DNA, 71 bp, chicken (Gallus Gallus)
  misc_feature (36): n=a or t
ttctgctaaagtggaactcgttttttctcaaaggcncttgctcattgtgactgtgaactgttgtattcaca

SEQ ID NO: 48446 - DNA, 71 bp, chicken (Gallus Gallus)
  misc_feature (36): n=c or g
atgttgataggaagtgtctaaagtggagaaaaagantcatgggaagagaaaatggagtgggaaatagagaa

SEQ ID NO: 48447 - DNA, 71 bp, chicken (Gallus Gallus)
  misc_feature (36): n=a or t
ttgaatgcccctcctgctgactctgcgtatgatcanaacaagactgactttgatgagacttcgtcaattaa

SEQ ID NO: 48448 - DNA, 71 bp, chicken (Gallus Gallus)
  misc_feature (36): n=a or t
ttgaagaaaaattttgttagattattctcacacaanctcattaaaattagagtgtaatttggttcaaaata

SEQ ID NO: 48449 - DNA, 71 bp, chicken (Gallus Gallus)
  misc_feature (36): n=c or g
agagaaaaagaaagtactagagcacttgtgaccaantggccaaaatcaaaagggacaacagctcccctttc

SEQ ID NO: 48450 - DNA, 71 bp, chicken (Gallus Gallus)
  misc_feature (36): n=a or t
tcttctcccagctacagccggttatgcatgactaangcagaggctgaagttccctaatgtttaaccaggtg

SEQ ID NO: 48451 - DNA, 71 bp, chicken (Gallus Gallus)
  misc_feature (36): n=c or g
taccatgacacatctgacctggatgcttctgatcanatcctataacaacacacaccctactactaactcta

SEQ ID NO: 48452 - DNA, 71 bp, chicken (Gallus Gallus)
  misc_feature (36): n=a or t
ttggtttgctgcactcactgtctttgcattactttnatccatgatgttagcaagaaaagcagttctcctgt

SEQ ID NO: 48453 - DNA, 71 bp, chicken (Gallus Gallus)
  misc_feature (36): n=c or g
aagcctctagcatggtgctgcaaactgcagaagtangtactaagggcaaagtcagtgtcttcttcaggaac

SEQ ID NO: 48454 - DNA, 71 bp, chicken (Gallus Gallus)
  misc_feature (36): n=a or t
ttgttagttctcccttcaccacaaatactttttttnatagtgaaagatgcacctcctgtaagctgtattag

SEQ ID NO: 48455 - DNA, 71 bp, chicken (Gallus Gallus)
  misc_feature (36): n=a or t
gtattcatgcatttcttctccagtcagggtcgtcanctggtgaggatttacacacccactgacttttgctc

SEQ ID NO: 48456 - DNA, 71 bp, chicken (Gallus Gallus)
  misc_feature (36): n=a or t
cctcttccacaacacgacagcccaacagtgcagacnccttttcacctgctcagtgatctatgctccccctg

SEQ ID NO: 48457 - DNA, 71 bp, chicken (Gallus Gallus)
  misc_feature (36): n=a or t
atacagtattttcacacattttggagacagaaaaanttatttggaagtccttcatgcactgctagctcatt

SEQ ID NO: 48458 - DNA, 71 bp, chicken (Gallus Gallus)
  misc_feature (36): n=c or g
cttgaaaagaaacacttaagctactgtggattaggnactggaacaataaatagcgggggaaatgcattttg

SEQ ID NO: 48459 - DNA, 71 bp, chicken (Gallus Gallus)
  misc_feature (36): n=c or g
tttttaaataaagcgtggggtttttccctgtgtttngggaaggttcagtgattcttgtaaaataacctcaa

SEQ ID NO: 48460 - DNA, 71 bp, chicken (Gallus Gallus)
  misc_feature (36): n=c or g
caactgtgggcaaggcacgcaaagttctaaactgtnttaaaagaattaagttaatgccttagtttttaagg

SEQ ID NO: 48461 - DNA, 71 bp, chicken (Gallus Gallus)
  misc_feature (36): n=a or t
gttctactttgtgtcaatgtgcaatgtaagggatgnaggagaagcagaccgcagtcctccgcttgcatccc

SEQ ID NO: 48462 - DNA, 71 bp, chicken (Gallus Gallus)
  misc_feature (36): n=c or g
aatcctgacttgcctgtctgcaaagggcagcctttnccttagatggcatctgtgcttgtaggtgtcgtgag

SEQ ID NO: 48463 - DNA, 71 bp, chicken (Gallus Gallus)
  misc_feature (36): n=c or g
agaaagctgagaacccctcctggttcgttgggcacnccgtgatctggccagctgaaatactggtagtgctt

SEQ ID NO: 48464 - DNA, 71 bp, chicken (Gallus Gallus)
  misc_feature (36): n=c or g
ctggaagaacacaaaattaggtttgtcacgtccctntagaataatttaagctggaaagaacctgcaggtgg

SEQ ID NO: 48465 - DNA, 71 bp, chicken (Gallus Gallus)
  misc_feature (36): n=c or g
ctggagtgaggtgagttccatggctatagctccccnacttctttctcccagagaatctagaatctaatcct

SEQ ID NO: 48466 - DNA, 71 bp, chicken (Gallus Gallus)
  misc_feature (36): n=c or g
attagctgtatcactggtgctattccttgtaaaaancctctcagcatctcaaagaatgagagaagacgcag

SEQ ID NO: 48467 - DNA, 71 bp, chicken (Gallus Gallus)
  misc_feature (36): n=a or t
ttgcgagaatttctctaattttaaatgggacttgantggttaattggttaagcattaataatctgtaggat

SEQ ID NO: 48468 - DNA, 71 bp, chicken (Gallus Gallus)
  misc_feature (36): n=a or t
aaataatttacaggttgatgctttccccgtttatanttgcaacttagtgtcataccaaatttaatacgttc

SEQ ID NO: 48469 - DNA, 71 bp, chicken (Gallus Gallus)
  misc_feature (36): n=c or g
cgccgcatcggggaagcagctgacaaaagaaaagcngtggtgcaaaacactgagatgaatttcttggagca

SEQ ID NO: 48470 - DNA, 71 bp, chicken (Gallus Gallus)
  misc_feature (36): n=a or t
agtgtgcatgacccctttccagatcaataaggatanacaaatgcccccatctcagcagataggttaaggct

SEQ ID NO: 48471 - DNA, 71 bp, chicken (Gallus Gallus)
  misc_feature (36): n=c or g
ttttcagaataaaagattaagtgttttcttttcctntgacagaacccagaatccttttaactaatttgttg

SEQ ID NO: 48472 - DNA, 71 bp, chicken (Gallus Gallus)
  misc_feature (36): n=a or t
agcgcaattctgcaaggtattgtgtcaagcactttnctagactatagatatatatattgcatttcttttat

SEQ ID NO: 48473 - DNA, 71 bp, chicken (Gallus Gallus)
  misc_feature (36): n=a or t
ctcatactgatgcaaagcaagttttctttaagagtntgtgctggcataagtaaaagatgtttagtgcccta

SEQ ID NO: 48474 - DNA, 71 bp, chicken (Gallus Gallus)
  misc_feature (36): n=a or t
actccttaattcattaatgaaaataaaataaactcnttgtcatgaatggaataaagaattgacggaggtgg

SEQ ID NO: 48475 - DNA, 71 bp, chicken (Gallus Gallus)
  misc_feature (36): n=c or g
ctgtgaaaatggctttttcccaaaggggatgtatgnccaggcttagaagaaccacagttatgcacagcaca

SEQ ID NO: 48476 - DNA, 71 bp, chicken (Gallus Gallus)
  misc_feature (36): n=a or t
attcttgtgacaaaagtgagaatatcagtttttttnaaatcttcattcaccacagaattcttgtatttctt

SEQ ID NO: 48477 - DNA, 71 bp, chicken (Gallus Gallus)
  misc_feature (36): n=c or g
acaaggatctcatctgaatatttggcatggccatgnactggaagtccagttgttcactgaaagcctgggga

SEQ ID NO: 48478 - DNA, 71 bp, chicken (Gallus Gallus)
  misc_feature (36): n=c or g
tgtttatcaactgtgatcctgatctctaagtactcnatcctcttcatgaactgagctgaggtcacattcct

SEQ ID NO: 48479 - DNA, 71 bp, chicken (Gallus Gallus)
  misc_feature (36): n=c or g
caactaccagccaccaatgtcttcaaatttaagtanaaagcagggcacaacatccacataaaaacacttct

SEQ ID NO: 48480 - DNA, 71 bp, chicken (Gallus Gallus)
  misc_feature (36): n=a or t
tcagattatgccagtagcctttgagacacgagaagnttggttttaatgtaggtgttacccaaaaactggtg

SEQ ID NO: 48481 - DNA, 71 bp, chicken (Gallus Gallus)
  misc_feature (36): n=c or g
aaccattatttttaatgtatatgcataagctctaanggatttaggtcttcactgcttggtgatttgcctag

SEQ ID NO: 48482 - DNA, 71 bp, chicken (Gallus Gallus)
  misc_feature (36): n=a or t
aattatctaagaagggttgttgaaatacagtgaacngagctgcttctacagctgtgcaataccatcattaa

SEQ ID NO: 48483 - DNA, 71 bp, chicken (Gallus Gallus)
  misc_feature (36): n=a or t
tacacattaacaaaagcagatcgatttaaagaaaancttagctaaagacatttaaaagcatcatatgtaaa

SEQ ID NO: 48484 - DNA, 71 bp, chicken (Gallus Gallus)
  misc_feature (36): n=a or t
agcaagaatcagcaagaggacattgccagaatagcngtatgagttcatattcactctttgatttatggcga

SEQ ID NO: 48485 - DNA, 71 bp, chicken (Gallus Gallus)
  misc_feature (36): n=a or t
ggtatcccaagacgtgcaaggaagcagtgtttctcntgtttcttttgcgctttttccgcagtcagctcagg

SEQ ID NO: 48486 - DNA, 71 bp, chicken (Gallus Gallus)
  misc_feature (36): n=a or t
agtccatctcggagtatctgcctcttgactttctcngttctgaaccagccagaatgcacttctgaatgaaa

SEQ ID NO: 48487 - DNA, 71 bp, chicken (Gallus Gallus)
  misc_feature (36): n=c or g
ccttctgttgagcgaacatttctacgtgcggcagangctatatacaaaacctccactagggggcgctctta

SEQ ID NO: 48488 - DNA, 71 bp, chicken (Gallus Gallus)
  misc_feature (36): n=a or t
actttcctttagaagctctgtatgcacgcagagaanaaacacatggcacatagcttggctttgtgttttga

SEQ ID NO: 48489 - DNA, 71 bp, chicken (Gallus Gallus)
  misc_feature (36): n=a or t
ttttcaggcatcttgggaagtgttataaatgatacngatcccaatgatgcggaataaaggcgaaatcagca

SEQ ID NO: 48490 - DNA, 71 bp, chicken (Gallus Gallus)
  misc_feature (36): n=c or g
gagtgtgggaggcagaagtaatccaaacaataaggnagatggaacaaaatcaaactgtgctgtggaaggaa

SEQ ID NO: 48491 - DNA, 71 bp, chicken (Gallus Gallus)
  misc_feature (36): n=c or g
gcaaggagaagtgtgtgagctcccagtgagcttcanagtgcattgcagccagggcaggcagtgccttggtc

SEQ ID NO: 48492 - DNA, 71 bp, chicken (Gallus Gallus)
  misc_feature (36): n=a or t
cccacaagaaatgtctggttttcagggatgctatcntcaacttagaagtgtatgacattattgcctctgaa

SEQ ID NO: 48493 - DNA, 71 bp, chicken (Gallus Gallus)
  misc_feature (36): n=a or t
aaaatataaagaaattttgtttaaggaatagatganattaagccttcaaagtagtatagaactccactagt

SEQ ID NO: 48494 - DNA, 71 bp, chicken (Gallus Gallus)
  misc_feature (36): n=c or g
gtttacacgtgcaacaacttgtatgtctggacactntgagctctgaggtgccattagctggaatttgattt

SEQ ID NO: 48495 - DNA, 71 bp, chicken (Gallus Gallus)
  misc_feature (36): n=c or g
ccagtgtgccaaccccgctggctggctctcacacanacttcctaagtgccagcatgggttattggtgtgta

SEQ ID NO: 48496 - DNA, 71 bp, chicken (Gallus Gallus)
  misc_feature (36): n=c or g
ctgcttgggaaaagaaagggttaaaggcactggaanggcttcactggggaggggggaattatttacttatt

SEQ ID NO: 48497 - DNA, 71 bp, chicken (Gallus Gallus)
  misc_feature (36): n=a or t
ggaagggtgataaatcagtttaacaagatttctgtnatttcttattcttttcaaaccaagatagtacatta

SEQ ID NO: 48498 - DNA, 71 bp, chicken (Gallus Gallus)
  misc_feature (36): n=a or t
agccagtggaaggcaatgtggataatgagctgagangtcctgtgagaggaaagctcggagcggggtttcag

SEQ ID NO: 48499 - DNA, 71 bp, chicken (Gallus Gallus)
  misc_feature (36): n=c or g
tttgacttgggttggtaagaaatgacaagttggtgngtaaagtagttttgtattcttttctgtggtgttta

SEQ ID NO: 48500 - DNA, 71 bp, chicken (Gallus Gallus)
  misc_feature (36): n=a or t
aacaaaactttggtttcctgactgcctggcctgtgncttacccagttgttcatgattcctatcacatggac

SEQ ID NO: 48501 - DNA, 71 bp, chicken (Gallus Gallus)
  misc_feature (36): n=c or g
ctcgtgttgcaaaacacgaaggacagagcagccaancgatcataaggggaatcttgtcagcgcccattact

SEQ ID NO: 48502 - DNA, 71 bp, chicken (Gallus Gallus)
  misc_feature (36): n=a or t
atgttagcagagcttctgatgagtgtggagagatcnaaaaccctggcacatctgggaggcaaaacatgcac

SEQ ID NO: 48503 - DNA, 71 bp, chicken (Gallus Gallus)
  misc_feature (36): n=c or g
aacagccctgacagccttgcaaaaatagttgcatgnttccaatgggagagccatcatatgtgatggtggtg

SEQ ID NO: 48504 - DNA, 71 bp, chicken (Gallus Gallus)
  misc_feature (36): n=a or t
tttgaagcacaaatacaattattaatactatagaantttctgttttagattgctagaggaagcgagtgaat

SEQ ID NO: 48505 - DNA, 71 bp, chicken (Gallus Gallus)
  misc_feature (36): n=c or g
tgttacaggcaagagtaaacagtagaagaaaaatgntctgtgtaacagtttgacagacattttttgttgcc

SEQ ID NO: 48506 - DNA, 71 bp, chicken (Gallus Gallus)
  misc_feature (36): n=c or g
tctagatctgggttagcatctgtcacagaaatgctntaacaaggtctatgccccaccctaggcagaaattg

SEQ ID NO: 48507 - DNA, 71 bp, chicken (Gallus Gallus)
  misc_feature (36): n=a or t
cccttgctttgatagttgtaaagggaaatgatgcanattccctgaacagtaggaaaattagtatcaaaata

SEQ ID NO: 48508 - DNA, 71 bp, chicken (Gallus Gallus)
  misc_feature (36): n=c or g
tactcagaaaataatctctatcatcttctgagatgnaacccatttcataagatatttgacttctacaccaa

SEQ ID NO: 48509 - DNA, 71 bp, chicken (Gallus Gallus)
  misc_feature (36): n=a or t
cttcctcttgcccagttcataagtacatgtggcatngtcacagacatgaagtggcaaatgattcatctact

SEQ ID NO: 48510 - DNA, 71 bp, chicken (Gallus Gallus)
  misc_feature (36): n=c or g
cttgcagaaccagtttgaactatctaaaaaagtttnttatcttcaaataaaacacttactgatgcatggac

SEQ ID NO: 48511 - DNA, 71 bp, chicken (Gallus Gallus)
  misc_feature (36): n=a or t
tgttgttgttaaagggaaatacttgaaaaagcttcnctagcaatagtactaaaggaggggaattgatctga

SEQ ID NO: 48512 - DNA, 71 bp, chicken (Gallus Gallus)
  misc_feature (36): n=a or t
tgcagttatacatttgctttatttgaagatcatacngagactctggcaaaatagttctaaggggttttaca

SEQ ID NO: 48513 - DNA, 71 bp, chicken (Gallus Gallus)
  misc_feature (36): n=c or g
atggagagcctgactgtgaaacctctacttctacantgacacagggcgggctggaagagatcaatcctgaa

SEQ ID NO: 48514 - DNA, 71 bp, chicken (Gallus Gallus)
  misc_feature (36): n=c or g
tttttaatgttttcaaattaagatccaaagtttcanaacaggatatttttaattggaatgtcacattgtct

SEQ ID NO: 48515 - DNA, 71 bp, chicken (Gallus Gallus)
  misc_feature (36): n=c or g
gaggtgcaaacctgaggacagatttcccctttgggnctcatttctattgctgacaccaactgcctgaaggc

SEQ ID NO: 48516 - DNA, 71 bp, chicken (Gallus Gallus)
  misc_feature (36): n=a or t
tcatacaaatttaaatgtttaagtgttttaggaganaagattttataggtggacagcatgtttaatgttga

SEQ ID NO: 48517 - DNA, 71 bp, chicken (Gallus Gallus)
  misc_feature (36): n=c or g
tcagtgctcctgaattcaagctttcatttgagaaanttttgctatccatcacagttataacaatgaccttc

SEQ ID NO: 48518 - DNA, 71 bp, chicken (Gallus Gallus)
  misc_feature (36): n=c or g
aatgtcagccaaggagagggaccgtgcacatctctnagtggtgtttggtgcccaggtttgggtggtcacaa

SEQ ID NO: 48519 - DNA, 71 bp, chicken (Gallus Gallus)
  misc_feature (36): n=c or g
attcagaagttaaatcaaatgatacattgctatcanagaagacataattaatgacagtctggaaggaaagg

SEQ ID NO: 48520 - DNA, 71 bp, chicken (Gallus Gallus)
  misc_feature (36): n=a or t
cacatcttcaaaagcagggcacacatttctctaacngacagcatgttaagtggatattattcttcagcact

SEQ ID NO: 48521 - DNA, 71 bp, chicken (Gallus Gallus)
  misc_feature (36): n=a or t
ctggccagttctgtcttgaaatccactgtttctttntgagctaatgcctagaaactaattggtattttgaa

SEQ ID NO: 48522 - DNA, 71 bp, chicken (Gallus Gallus)
  misc_feature (36): n=c or g
ccagctgtgccctccccaaatttgcaaatcttggangatgctttgggtccctccataattaacagcgccac

SEQ ID NO: 48523 - DNA, 71 bp, chicken (Gallus Gallus)
  misc_feature (36): n=c or g
gctgatggtcttattatcctcactgtcatcagcctnagtcactctgtgcccctttgttacactctctggaa

SEQ ID NO: 48524 - DNA, 71 bp, chicken (Gallus Gallus)
  misc_feature (36): n=a or t
tcaactgcttggtgccacttgacaaacgaggaagcngcaaacagagcaatgaagtaattttctacacacag

SEQ ID NO: 48525 - DNA, 71 bp, chicken (Gallus Gallus)
  misc_feature (36): n=a or t
agtatatgaaagacataccacaggcaaattgagatncaaagtttgggtttttgatcccagagagagaaaat

SEQ ID NO: 48526 - DNA, 71 bp, chicken (Gallus Gallus)
  misc_feature (36): n=c or g
tcttcattaagaaccaagccaaaaagctgagagtgncccagtttcatggagcaggaccatagtttaggagc

SEQ ID NO: 48527 - DNA, 71 bp, chicken (Gallus Gallus)
  misc_feature (36): n=c or g
catattccgaattttaagtgtaagttaccataaatntcccagtggcttcaggagtctcactcctcaacatt

SEQ ID NO: 48528 - DNA, 71 bp, chicken (Gallus Gallus)
  misc_feature (36): n=c or g
agtgcagtgctctgctatattgtatagaatttgctngtgtctgttagggggattgacgtttacttaaagcc

SEQ ID NO: 48529 - DNA, 71 bp, chicken (Gallus Gallus)
  misc_feature (36): n=c or g
tgaatgcttactttggagtaattacactgttgaacntaatttccctttgtgctttgtcttacagagacctg

SEQ ID NO: 48530 - DNA, 71 bp, chicken (Gallus Gallus)
  misc_feature (36): n=a or t
tcacaatattatcaatgaaaatacagttgatctcanctctctaacaaaaacactttgaattttaaatcccc

SEQ ID NO: 48531 - DNA, 71 bp, chicken (Gallus Gallus)
  misc_feature (36): n=c or g
cacggcttatactgcagtgtctgggagccttccccntgccttgaggacaatcctgtgtaaaaatgctgcgc

SEQ ID NO: 48532 - DNA, 71 bp, chicken (Gallus Gallus)
  misc_feature (36): n=c or g
gcccttgtgctacccctctgactaaaatctctagangaattggagctgggctttcttcatgcctagttcac

SEQ ID NO: 48533 - DNA, 71 bp, chicken (Gallus Gallus)
  misc_feature (36): n=c or g
acggggacactgggggacatctgaagggggacacantggggaaaccacagcaagagggaagggcgatgctt

SEQ ID NO: 48534 - DNA, 71 bp, chicken (Gallus Gallus)
  misc_feature (36): n=c or g
atttttcccccctctgtttcttcagaaaaggacaanagttatgcttgcttgaaaattttattgacacaact

SEQ ID NO: 48535 - DNA, 71 bp, chicken (Gallus Gallus)
  misc_feature (36): n=c or g
gagctctgcagctcccctgtgcataggacaagactnttcataattgggagagctgctttaatttggctgaa

SEQ ID NO: 48536 - DNA, 71 bp, chicken (Gallus Gallus)
  misc_feature (36): n=c or g
catggaggtaagacagtgctgctgaacccagaaaancaactttcagctatgccttcttgttttctggtgct

SEQ ID NO: 48537 - DNA, 71 bp, chicken (Gallus Gallus)
  misc_feature (36): n=a or t
aaacattctgaagtgtactgtgtgcctttggtgggngcaaaggagtttcaagatgaatattatcagccaac

SEQ ID NO: 48538 - DNA, 71 bp, chicken (Gallus Gallus)
  misc_feature (36): n=a or t
acagtaaagtgtttttcatgaacctccctgctggcncctgcttgaacaaggatgcctgggaaagatctctg

SEQ ID NO: 48539 - DNA, 71 bp, chicken (Gallus Gallus)
  misc_feature (36): n=c or g
gctggcgctgggctcgctccgggtcgctctgtgctntgctcctttggtggcccttccagtgctgggggaca

SEQ ID NO: 48540 - DNA, 71 bp, chicken (Gallus Gallus)
  misc_feature (36): n=a or t
aaaacactcacctaactagggctatcaagtttctgngttgggtttgtgcatctataaactaccagtggctt

SEQ ID NO: 48541 - DNA, 71 bp, chicken (Gallus Gallus)
  misc_feature (36): n=a or t
ttttagccatcaaggtatttcttcctagcttttatngcaggacaggtccagcatgctaaaagggggggctt

SEQ ID NO: 48542 - DNA, 71 bp, chicken (Gallus Gallus)
  misc_feature (36): n=a or t
aagcgtgagatcctcactgtggtgaatagcagagcnaagtcctgcagactccatggagtggtgtattcagt

SEQ ID NO: 48543 - DNA, 71 bp, chicken (Gallus Gallus)
  misc_feature (36): n=a or t
tagagattaactgcaatacataagtcagttcattcncaatttcatcgtttattcttcttatttatagatat

SEQ ID NO: 48544 - DNA, 71 bp, chicken (Gallus Gallus)
  misc_feature (36): n=a or t
tagggtctgtaaacaccgtggagtcttttcaacaanaattttgtctttctgcagttctgtatatctactaa

SEQ ID NO: 48545 - DNA, 71 bp, chicken (Gallus Gallus)
  misc_feature (36): n=a or t
tttattttcagcacagtgttcagtttctaagggaantcaaaccaaactccaatctctgtctgaaagcaaat

SEQ ID NO: 48546 - DNA, 71 bp, chicken (Gallus Gallus)
  misc_feature (36): n=a or t
gttcattcagatccagactagcatctctatcgcagngcactgcatggataagatcagtaatgaactcataa

SEQ ID NO: 48547 - DNA, 71 bp, chicken (Gallus Gallus)
  misc_feature (36): n=c or g
cctttcctctcgctccctctaccccagattacaaanccacttgactagttttatcctctagctataccata

SEQ ID NO: 48548 - DNA, 71 bp, chicken (Gallus Gallus)
  misc_feature (36): n=c or g
cagaactgtaagatgtctctcagcatcctatgaggnaccccagagcagtgactatgcaggggtggttacct

SEQ ID NO: 48549 - DNA, 71 bp, chicken (Gallus Gallus)
  misc_feature (36): n=c or g
aagtacctaattttgcaatattagtgatgtttgcancttgataatggctaatcatcctccacttccctgtt

SEQ ID NO: 48550 - DNA, 71 bp, chicken (Gallus Gallus)
  misc_feature (36): n=a or t
aggttgtttctcagcttttaagtattttcaggttgnctactgtgaataaaggactgcatttctgaacatgc

SEQ ID NO: 48551 - DNA, 71 bp, chicken (Gallus Gallus)
  misc_feature (36): n=a or t
gtgcataccctcaccaaatcctggcaaaacaggtgntccaataagacattcttactttgcacactaccaat

SEQ ID NO: 48552 - DNA, 71 bp, chicken (Gallus Gallus)
  misc_feature (36): n=a or t
accctgctctgctgggtgggcgtaaggtcgtagctnactgctgatttcagatgggagctcacagaaccatg

SEQ ID NO: 48553 - DNA, 71 bp, chicken (Gallus Gallus)
  misc_feature (36): n=c or g
tgcatctaattaagagacatccaaaattatctattnaattacatcctatcacacatataattagagaaata

SEQ ID NO: 48554 - DNA, 71 bp, chicken (Gallus Gallus)
  misc_feature (36): n=c or g
tgagctgcattcaggagagcctgtggaggatcattnctgcagctccagacaggccaggcacaaagcttggg

SEQ ID NO: 48555 - DNA, 71 bp, chicken (Gallus Gallus)
  misc_feature (36): n=c or g
tctatcaatgcaacagtatgaatagaaaactaaatncaacttctttttcattaacaactctaactcctaat

SEQ ID NO: 48556 - DNA, 71 bp, chicken (Gallus Gallus)
  misc_feature (36): n=c or g
aaggcccaaaagccaagtggagtagtttttgctatntcatacacagccaaaaactgcagcagatttgccca

SEQ ID NO: 48557 - DNA, 71 bp, chicken (Gallus Gallus)
  misc_feature (36): n=a or t
ttaggaatcattacactgtttggttctccccacacnttcttcttatctacgacgcagagatcaaaccatct

SEQ ID NO: 48558 - DNA, 71 bp, chicken (Gallus Gallus)
  misc_feature (36): n=a or t
gaggtcccgcctgaattgtcagcctacctgaagagncagagcacaacaagggtgtcattagcataagcaac

SEQ ID NO: 48559 - DNA, 71 bp, chicken (Gallus Gallus)
  misc_feature (36): n=c or g
atggatgtgtacctgtacacatatgcaaacacacangtggcatgtaataccgcttacatcagactgtcagg

SEQ ID NO: 48560 - DNA, 71 bp, chicken (Gallus Gallus)
  misc_feature (36): n=a or t
ggatgtaaagtacattttgtaataatgcatcagatntatataaatactgagtgttaagtttaactcactct

SEQ ID NO: 48561 - DNA, 71 bp, chicken (Gallus Gallus)
  misc_feature (36): n=a or t
tttcagtgtctcacttgtctttaattgcacgatgantgctttccatttgaatccttcattaaaagcactat

SEQ ID NO: 48562 - DNA, 71 bp, chicken (Gallus Gallus)
  misc_feature (36): n=c or g
ctccatttggtagctatggtccagagatgtctacanagagcaaggtctgattttgtagggtgcctgaaact

SEQ ID NO: 48563 - DNA, 71 bp, chicken (Gallus Gallus)
  misc_feature (36): n=c or g
tagatttttatcctttccagaaggttcggctcattngtcaatgagaaaaaaccagtcagaagcaatcagtg

SEQ ID NO: 48564 - DNA, 71 bp, chicken (Gallus Gallus)
  misc_feature (36): n=c or g
gggggggaatgtgccaggcaaaaaaatcataggcancaataaatcctcctgcaacggtctgaagaatgaaa

SEQ ID NO: 48565 - DNA, 71 bp, chicken (Gallus Gallus)
  misc_feature (36): n=a or t
cctgttaactactcaggtggaacattacttggcccngcagaagagaggaaggatgattctgcaataaaata

SEQ ID NO: 48566 - DNA, 71 bp, chicken (Gallus Gallus)
  misc_feature (36): n=c or g
tccattctgggggaaaacaagaaacaagggaaatgnaatgagatcctatcacatatccctcccacactgtc

SEQ ID NO: 48567 - DNA, 71 bp, chicken (Gallus Gallus)
  misc_feature (36): n=c or g
aattcactgagttcactgtcttagatgaaattctgntataagcaataccagtaagagagttggtgaatctt

SEQ ID NO: 48568 - DNA, 71 bp, chicken (Gallus Gallus)
  misc_feature (36): n=a or t
gaatacctgatgctgagggagaatttcattaagganctggtcactctggtgtagctttttagaaagttgga

SEQ ID NO: 48569 - DNA, 71 bp, chicken (Gallus Gallus)
  misc_feature (36): n=c or g
ccctgcggcctgcgtcccgcagagcagagagacagngctgtaaccgctgcctgaatttgaactgctcccgc

SEQ ID NO: 48570 - DNA, 71 bp, chicken (Gallus Gallus)
  misc_feature (36): n=c or g
tgtcctttggtagtctgttctgctcataccctttcnactcacgcatacagaactctttcaatatgatgctt

SEQ ID NO: 48571 - DNA, 71 bp, chicken (Gallus Gallus)
  misc_feature (36): n=c or g
catattcctaaagctgatccattctcactttccaancaaaaaaagttttccattgatgattattctcttcc

SEQ ID NO: 48572 - DNA, 71 bp, chicken (Gallus Gallus)
  misc_feature (36): n=a or t
gaaagcctctggttttcctaaattgtgaagagatanttaatctacatttctacaagatttagaaggtggca

SEQ ID NO: 48573 - DNA, 71 bp, chicken (Gallus Gallus)
  misc_feature (36): n=a or t
tcattgacagactgggttggaaggggaaatgaggtngtagcaagactggacatgacaagatgttggacagc

SEQ ID NO: 48574 - DNA, 71 bp, chicken (Gallus Gallus)
  misc_feature (36): n=a or t
agatctgttattccaaaataaagtgaaacaagaacntaaaaatggttttgctcatatttctatatattctc

SEQ ID NO: 48575 - DNA, 71 bp, chicken (Gallus Gallus)
  misc_feature (36): n=c or g
aaccactctagtagggtcaagcattaaggctttcanccagcattaagatattcccccatacaaagtgaaag

SEQ ID NO: 48576 - DNA, 71 bp, chicken (Gallus Gallus)
  misc_feature (36): n=a or t
gtaagtttttgtgagaacaagatcaaagtgtaaatngtttgcaaagggatacattttgctttcaacagaga

SEQ ID NO: 48577 - DNA, 71 bp, chicken (Gallus Gallus)
  misc_feature (36): n=c or g
ggtgccactctgcaaagaggtaaaataatggctttngcagctcagagcacagggtgagccacagcaacata

SEQ ID NO: 48578 - DNA, 71 bp, chicken (Gallus Gallus)
  misc_feature (36): n=c or g
tccatactattctagataactaggagatatttttantaatggtatttctatcaactaatttgggataaaaa

SEQ ID NO: 48579 - DNA, 71 bp, chicken (Gallus Gallus)
  misc_feature (36): n=a or t
caacctcctctctaggagctaagtacatggaaatcntgtgttagaacatgccatgaaatagcaataacagc

SEQ ID NO: 48580 - DNA, 71 bp, chicken (Gallus Gallus)
  misc_feature (36): n=c or g
acatctaacaaaacaagataatctgttcgccccaantattagcttacatgcaagcactgctttgtggaaga

SEQ ID NO: 48581 - DNA, 71 bp, chicken (Gallus Gallus)
  misc_feature (36): n=c or g
tagaattatgctctgccctgactctcataacaactntgggcttattatttttccacaagtcaaacccatct

SEQ ID NO: 48582 - DNA, 71 bp, chicken (Gallus Gallus)
  misc_feature (36): n=c or g
ggacaaccaaaggccaaggcacgaaaaacaggattnaccttgttactcataccatcctgctaatgggcaat

SEQ ID NO: 48583 - DNA, 71 bp, chicken (Gallus Gallus)
  misc_feature (36): n=a or t
cttggacgtatgtcagtaatacaggaaaaaaggccntcctgaggccaaataatcccatttgaaatgcccct

SEQ ID NO: 48584 - DNA, 71 bp, chicken (Gallus Gallus)
  misc_feature (36): n=a or t
tcttttgaaaatgggcatccttcgcaacctggtccnccacagttgacaagggcatctgcagatgttctttc

SEQ ID NO: 48585 - DNA, 71 bp, chicken (Gallus Gallus)
  misc_feature (36): n=c or g
tgtactctgagaaatgatgagcaatagatgagaaanttgagttgctgtctgtgacccatcctgaaatttaa

SEQ ID NO: 48586 - DNA, 71 bp, chicken (Gallus Gallus)
  misc_feature (36): n=c or g
ctaaaaggtgccaaagttctatggtttttaaggacngttccaatccagagccaagcattctacggtcctat

SEQ ID NO: 48587 - DNA, 71 bp, chicken (Gallus Gallus)
  misc_feature (36): n=a or t
atgtattattttcaggaaatactaatgattttgtanccttctttgtgctttaggagctcgttcgaaaaggg

SEQ ID NO: 48588 - DNA, 71 bp, chicken (Gallus Gallus)
  misc_feature (36): n=c or g
gctccctggaagtctggtccttgctgcaggtccaantcctggctctttggcacaaaaggagcctggagctg

SEQ ID NO: 48589 - DNA, 71 bp, chicken (Gallus Gallus)
  misc_feature (36): n=c or g
tgactccagtgagtgggtgataacacctaaattctntatagcgtacaaatgtgcaagctgaaaaggaagta

SEQ ID NO: 48590 - DNA, 71 bp, chicken (Gallus Gallus)
  misc_feature (36): n=a or t
atcacctctggtttcagaaggaggaatgcacaaacncttagaagctaattcccaaacccactgagacaaag

SEQ ID NO: 48591 - DNA, 71 bp, chicken (Gallus Gallus)
  misc_feature (36): n=c or g
ggagacctgaaagttttgtacaaaacctacctacancctcattgttaagtctattcaattgaaaaatataa

SEQ ID NO: 48592 - DNA, 71 bp, chicken (Gallus Gallus)
  misc_feature (36): n=c or g
caaatgattaaggccaagtgggtgaatcaataacanttttagttatgaagttttgcagaacaattttatga

SEQ ID NO: 48593 - DNA, 71 bp, chicken (Gallus Gallus)
  misc_feature (36): n=a or t
gtccttctaaatatagaagccctaatacaccatttnacaaagagctgaagtaacacttcagtttacctagg

SEQ ID NO: 48594 - DNA, 71 bp, chicken (Gallus Gallus)
  misc_feature (36): n=c or g
tacacaccacctcctcgcaaacaagacactgaggancacaacattgctgtcaggttacccggcagtcccca

SEQ ID NO: 48595 - DNA, 71 bp, chicken (Gallus Gallus)
  misc_feature (36): n=c or g
tccattctccacttatcctgcatctctctcaagcanagaaaccgttcactgagcttatgtaattcaaaaaa

SEQ ID NO: 48596 - DNA, 71 bp, chicken (Gallus Gallus)
  misc_feature (36): n=c or g
tagaagatgaagatacagcttaagtcggtgtgtggnaggtgatgggggtggggaggaaggcacagagaatt

SEQ ID NO: 48597 - DNA, 71 bp, chicken (Gallus Gallus)
  misc_feature (36): n=c or g
gccagcccgccgctgcacagagatgcatgggaaganggcaggccattgccactgcatgctgctggtggcac

SEQ ID NO: 48598 - DNA, 71 bp, chicken (Gallus Gallus)
  misc_feature (36): n=c or g
tgattctgttgttgcttgcttctgagttaccttaanagtaaaaaatggctaacaacacctatatgaattaa

SEQ ID NO: 48599 - DNA, 71 bp, chicken (Gallus Gallus)
  misc_feature (36): n=c or g
agccaagcacgtggcagagctgggtgtgatgtcccnagagaagggcagggaccctcttggaaacgctcagg

SEQ ID NO: 48600 - DNA, 71 bp, chicken (Gallus Gallus)
  misc_feature (36): n=a or t
aagcctgagctagcttcagaatcaatccagcagggntatgcacctgacctaagtcttcaactgttgtatta

SEQ ID NO: 48601 - DNA, 71 bp, chicken (Gallus Gallus)
  misc_feature (36): n=c or g
tcttagataaacagtttaggaagacatagctctttnctgttgcactgaactgtttgttttatcaggtgtat

SEQ ID NO: 48602 - DNA, 71 bp, chicken (Gallus Gallus)
  misc_feature (36): n=a or t
cttagtgaggtttaggctagtgatggctgacattcngatgatatgtagttcgtttaggcttgtttagtaat

SEQ ID NO: 48603 - DNA, 71 bp, chicken (Gallus Gallus)
  misc_feature (36): n=c or g
cggtccccctcaggccgcccttcggagctttgtagngttggtttccttccttctatcagtttattttggtt

SEQ ID NO: 48604 - DNA, 71 bp, chicken (Gallus Gallus)
  misc_feature (36): n=c or g
actctttgtccacattcagttctgaatcatgtttcngtttacaactgctgaactcagatctcttttctttt

SEQ ID NO: 48605 - DNA, 71 bp, chicken (Gallus Gallus)
  misc_feature (36): n=a or t
ggaaaccaatgagaaagataaaatatagtgtagttnagcataagtactactgtgctttcctatttagaaaa

SEQ ID NO: 48606 - DNA, 71 bp, chicken (Gallus Gallus)
  misc_feature (36): n=a or t
aaggagtcaaaatcagcttagacagactataagatntttcatgatgatttaaagtgtatatttgagtctag

SEQ ID NO: 48607 - DNA, 71 bp, chicken (Gallus Gallus)
  misc_feature (36): n=a or t
acgaagtcagtaataccaaataggagctgctttgcntctgaaattgacaaatcctattttgaaagcatgca

SEQ ID NO: 48608 - DNA, 71 bp, chicken (Gallus Gallus)
  misc_feature (36): n=c or g
cctgccatgtggagcttgtgggactgctcctctgtntaaacgcttacagaagcagagctctaaacccaaat

SEQ ID NO: 48609 - DNA, 71 bp, chicken (Gallus Gallus)
  misc_feature (36): n=a or t
tttgtgcaagccccaacaaaagctgagatgtttaancatgtgagacaggagacattctctttcctttactt

SEQ ID NO: 48610 - DNA, 71 bp, chicken (Gallus Gallus)
  misc_feature (36): n=a or t
tgaagagaaatgggaaagtcagcctaaaagcaattnctgacttacctagtagtaaggggacaatattttcc

SEQ ID NO: 48611 - DNA, 71 bp, chicken (Gallus Gallus)
  misc_feature (36): n=c or g
ttacaagttatctgcgtaagtgcacttaattgaagntctttaaacaagctcatgaagagtttcctatatgc

SEQ ID NO: 48612 - DNA, 71 bp, chicken (Gallus Gallus)
  misc_feature (36): n=c or g
tactgaacgcaacgcacatccaaactgattgcatancaagacacttcagatgaaggaatcataaagatggc

SEQ ID NO: 48613 - DNA, 71 bp, chicken (Gallus Gallus)
  misc_feature (36): n=c or g
ttttaggagtgatctctgggatttagtctgaattangctgaaagtagtccattagtatttcaaagaaccct

SEQ ID NO: 48614 - DNA, 71 bp, chicken (Gallus Gallus)
  misc_feature (36): n=c or g
gttttaatattttttttactaatgcagctgcagtancactgcagaaccaaggcaggtgtgtcaaaatcaaa

SEQ ID NO: 48615 - DNA, 71 bp, chicken (Gallus Gallus)
  misc_feature (36): n=c or g
ttgttagaacagaaactcaaaagttaagcctagaanaaaaatattattttcttctttgtgggatatctata

SEQ ID NO: 48616 - DNA, 71 bp, chicken (Gallus Gallus)
  misc_feature (36): n=a or t
agaaggctgcaagatcggtcaacacaatttagctangtccacagtccagcgttcaatctgcagtacttgag

SEQ ID NO: 48617 - DNA, 71 bp, chicken (Gallus Gallus)
  misc_feature (36): n=c or g
ctattttgtatgggtatctgttgttgaaggtgaggngggacaggctcagcaggctgcatgtttctgctgaa

SEQ ID NO: 48618 - DNA, 71 bp, chicken (Gallus Gallus)
  misc_feature (36): n=a or t
taattaaaatcttgacctctgaaatgaaacttcagngaaaatgtaaggacctcaacattggtctgttgtat

SEQ ID NO: 48619 - DNA, 71 bp, chicken (Gallus Gallus)
  misc_feature (36): n=a or t
cagattaagttgttcacatggaaaccacagtatatnccctacaataatcatactagaagaccagaatggga

SEQ ID NO: 48620 - DNA, 71 bp, chicken (Gallus Gallus)
  misc_feature (36): n=a or t
gataaaccttgtgggtatcattggttttgtggtgtnaaagaaaaaaggaaacagattgtgtgagaaaacaa

SEQ ID NO: 48621 - DNA, 71 bp, chicken (Gallus Gallus)
  misc_feature (36): n=a or t
acatcgctcctccttctgggttataaaaatcagaancatcatgccaagacccactgcagacccaccccaaa

SEQ ID NO: 48622 - DNA, 71 bp, chicken (Gallus Gallus)
  misc_feature (36): n=a or t
ttattaatatgtgttgggctgaatgtgtaattaatntatgcatctgtctaggagtgggcactctttccttc

SEQ ID NO: 48623 - DNA, 71 bp, chicken (Gallus Gallus)
  misc_feature (36): n=a or t
tcctctgcagttctggaaatctgaggatcaaaaagntgatggacagatcaaataacacgaatggatacaga

SEQ ID NO: 48624 - DNA, 71 bp, chicken (Gallus Gallus)
  misc_feature (36): n=a or t
tgatgcacagtatacttttataactactgatattgnattttgtgaatggaagtttccagtcccaaaaaatt

SEQ ID NO: 48625 - DNA, 71 bp, chicken (Gallus Gallus)
  misc_feature (36): n=c or g
ttcttgaggcttaatttggaatgaacactttttccngggaacttgtttcttcttttagaatcctttgcatc

SEQ ID NO: 48626 - DNA, 71 bp, chicken (Gallus Gallus)
  misc_feature (36): n=a or t
acaacatctattttccctttggtatctctcacctgntactggacaattggtgcagtgcaaacatctctctg

SEQ ID NO: 48627 - DNA, 71 bp, chicken (Gallus Gallus)
  misc_feature (36): n=a or t
acctttcagtgagcccaaaggaactaagttcatttntagatatattacatcagattgcactatacagtctt

SEQ ID NO: 48628 - DNA, 71 bp, chicken (Gallus Gallus)
  misc_feature (36): n=a or t
tttaagaaagcccagaaacactccatgttctctaanccacaaaactggacaattacaggtatgcagtaaaa

SEQ ID NO: 48629 - DNA, 71 bp, chicken (Gallus Gallus)
  misc_feature (36): n=c or g
tgttttccagcagccattattgggtatcagccaggnagcccagctctcacatcagcatcccacatcatcag

SEQ ID NO: 48630 - DNA, 71 bp, chicken (Gallus Gallus)
  misc_feature (36): n=a or t
tcgagccgaaggccaagcttgagacagagttccatntccaagcagaagactgaaaagaacggcgcttgcac

SEQ ID NO: 48631 - DNA, 71 bp, chicken (Gallus Gallus)
  misc_feature (36): n=c or g
ctctcgccatgcctgtcccaccaggcaggtcccatntccatgaggggaaccaaggcctgcccagacaccag

SEQ ID NO: 48632 - DNA, 71 bp, chicken (Gallus Gallus)
  misc_feature (36): n=c or g
aaatggcagtcattccattactcaatttttcttgtnttttatacagctctgtctttcccttccctctgcat

SEQ ID NO: 48633 - DNA, 71 bp, chicken (Gallus Gallus)
  misc_feature (36): n=c or g
ccccagaccattaataacttgccctgacatcttttntcactacgtaactcaatattataaaaactaggggg

SEQ ID NO: 48634 - DNA, 71 bp, chicken (Gallus Gallus)
  misc_feature (36): n=c or g
tttgcagaaggaagactacccacctccttagccttnaaaatgtgtggagggggaagggcagcattgcttgt

SEQ ID NO: 48635 - DNA, 71 bp, chicken (Gallus Gallus)
  misc_feature (36): n=c or g
ttacaaagcctgttctatgctcttcaatgcctgtgnatttacagtagcttttgtttcctggtgcctttgtt

SEQ ID NO: 48636 - DNA, 71 bp, chicken (Gallus Gallus)
  misc_feature (36): n=a or t
agaatctagctggcaaatagaacctaaatctatccnataaaatgtggcgatattcaagagaatgaagcatt

SEQ ID NO: 48637 - DNA, 71 bp, chicken (Gallus Gallus)
  misc_feature (36): n=a or t
aaaaaaacagaaagtccaggcaaaaagagaaggatntgatgctgtgaatctgtatctactgttattattgt

SEQ ID NO: 48638 - DNA, 71 bp, chicken (Gallus Gallus)
  misc_feature (36): n=a or t
gagatccagctactcccctgcagatcacaagtaccncaatgccaactctaaacagcccagattgctatttc

SEQ ID NO: 48639 - DNA, 71 bp, chicken (Gallus Gallus)
  misc_feature (36): n=c or g
agactattccaaaacacagtaaagaaccattcgctntgagatctccgtgtctcagccttatatttgcacag

SEQ ID NO: 48640 - DNA, 71 bp, chicken (Gallus Gallus)
  misc_feature (36): n=c or g
agagtaaaaaggtcccccagggtaatagatggaaanttaaataagaaataactgacgattgccagaaaaaa

SEQ ID NO: 48641 - DNA, 71 bp, chicken (Gallus Gallus)
  misc_feature (36): n=c or g
aagtataaaaataagtgatgcgattctgttagcaantgggaatgagttttctgtttagaatgcatagaaga

SEQ ID NO: 48642 - DNA, 71 bp, chicken (Gallus Gallus)
  misc_feature (36): n=c or g
gtttatttgattaggcattatacaaatgtgtattanatgatatatcttctcagaaataatttccttttagt

SEQ ID NO: 48643 - DNA, 71 bp, chicken (Gallus Gallus)
  misc_feature (36): n=a or t
tattaataataaaataggacttagtatttcatcctnggacttgtttgatgcctacgtggacactctgacag

SEQ ID NO: 48644 - DNA, 71 bp, chicken (Gallus Gallus)
  misc_feature (36): n=a or t
atcagatgattctgctgcgaaagctgtgtctgccantgatgtgcttcttactgcacacggtgctgcatagt

SEQ ID NO: 48645 - DNA, 71 bp, chicken (Gallus Gallus)
  misc_feature (36): n=a or t
ggaacgctgcttcttggtataatgatagaagacaanataaagctgggtaacaaagatgcttggtaattgca

SEQ ID NO: 48646 - DNA, 71 bp, chicken (Gallus Gallus)
  misc_feature (36): n=c or g
gttggaaaaacacttggataaattgttttgcatctnacatgtcttgaaatgttttgatgcctccaagttcc

SEQ ID NO: 48647 - DNA, 71 bp, chicken (Gallus Gallus)
  misc_feature (36): n=a or t
tccccagtcattgttaatgatggttggggttccgtnatcgtgattcctattagtggaggtgtcatgtaagc

SEQ ID NO: 48648 - DNA, 71 bp, chicken (Gallus Gallus)
  misc_feature (36): n=a or t
ccagtgagtccacatgcattattctcaatttatccnaaatgccagaccccttcttttcatcgttgtgaaga

SEQ ID NO: 48649 - DNA, 71 bp, chicken (Gallus Gallus)
  misc_feature (36): n=a or t
gtggacagcattaacagtactgaattcattgttgcntttggtatccaaatagtgtctgaaattcagcaatg

SEQ ID NO: 48650 - DNA, 71 bp, chicken (Gallus Gallus)
  misc_feature (36): n=a or t
accagaaattgatatgttatgacttgggctgagacnaattccattttaagaggaaatatgtgttctgcttt

SEQ ID NO: 48651 - DNA, 71 bp, chicken (Gallus Gallus)
  misc_feature (36): n=c or g
tatatgttttatttcccgaagtaagttagaacatgnaatagaagggaattacagttttcctctaagtgctc

SEQ ID NO: 48652 - DNA, 71 bp, chicken (Gallus Gallus)
  misc_feature (36): n=c or g
gagccttgtccctgcttttcctagaaaaccaacagngagaaataggagccttgcagtgagcctgtgtgtct

SEQ ID NO: 48653 - DNA, 71 bp, chicken (Gallus Gallus)
  misc_feature (36): n=c or g
actaacagtggtgattaaacactgatagggtagcantcttctgatttgaatctcagtaggtgcagcaaaat

SEQ ID NO: 48654 - DNA, 71 bp, chicken (Gallus Gallus)
  misc_feature (36): n=a or t
tttaggaactgctgtatttagggcctgaatttgccngtgattttgcaaaggttttgcctttgttactgtta

SEQ ID NO: 48655 - DNA, 71 bp, chicken (Gallus Gallus)
  misc_feature (36): n=c or g
cagaaattacactgctgacttgtactgttgtcccantaggccagatgtttgctgtgggactgctatctgac

SEQ ID NO: 48656 - DNA, 71 bp, chicken (Gallus Gallus)
  misc_feature (36): n=a or t
aagggaagaggtgaagggaataattcttagaagctnacgtgagatctggcttattacatttccacagttag

SEQ ID NO: 48657 - DNA, 71 bp, chicken (Gallus Gallus)
  misc_feature (36): n=c or g
aatctgtaaccactaatgcttacaagatcagacctnagatctctgctcaagtagaaagcagtagcattttc

SEQ ID NO: 48658 - DNA, 71 bp, chicken (Gallus Gallus)
  misc_feature (36): n=c or g
cccacctgtctccccagtacagccactccagctctnttgagccgcattgtttccaaggtgaacaaacccat

SEQ ID NO: 48659 - DNA, 71 bp, chicken (Gallus Gallus)
  misc_feature (36): n=c or g
gctttgcacagtgatgacccttctatggcccttgancagaggaagtgctctgggggtaaattaaatcctgt

SEQ ID NO: 48660 - DNA, 71 bp, chicken (Gallus Gallus)
  misc_feature (36): n=a or t
atctgttgtgttgacactaacaccatgtgagaaccncttgtaactgaatttttattaatacagcaccaaat

SEQ ID NO: 48661 - DNA, 71 bp, chicken (Gallus Gallus)
  misc_feature (36): n=c or g
atcatccccagttgtataggtgcattgtgagactgnctggaagtcactgtgttacctcagcatcacggcat

SEQ ID NO: 48662 - DNA, 71 bp, chicken (Gallus Gallus)
  misc_feature (36): n=c or g
aggcatcatgtaagccagcatagaaaaacaaaaggnggggtgggggggagaggggaacaaaaacaaaaaca

SEQ ID NO: 48663 - DNA, 71 bp, chicken (Gallus Gallus)
  misc_feature (36): n=a or t
ttagaaaaatgacattcaaaaagcaatagcccttcntagaaagtttgctggagagctcaaggatgcagata

SEQ ID NO: 48664 - DNA, 71 bp, chicken (Gallus Gallus)
  misc_feature (36): n=a or t
agatattccatgggaaatactgtattagagattatngagtcaggtagaaatgggcataggagtatactgct

SEQ ID NO: 48665 - DNA, 71 bp, chicken (Gallus Gallus)
  misc_feature (36): n=c or g
ctttccccagtagtaaacacacgtagcattactgantgatgtcatggctggagcacatcccagcgaggcca

SEQ ID NO: 48666 - DNA, 71 bp, chicken (Gallus Gallus)
  misc_feature (36): n=a or t
caaaaacttatctgtagcagtatgattacatgattncacctctgtacttctgttttcgtcttactttaacg

SEQ ID NO: 48667 - DNA, 71 bp, chicken (Gallus Gallus)
  misc_feature (36): n=c or g
cccctgtctctccatgcttgtgactaaaggaacacncacgaaagcagtactctcgaggcgttctagagtga

SEQ ID NO: 48668 - DNA, 71 bp, chicken (Gallus Gallus)
  misc_feature (36): n=c or g
tctgtagagtgccaatggagattacagaaacgctgntctgagtttaatgtatatcactgttgtgccaatgg

SEQ ID NO: 48669 - DNA, 71 bp, chicken (Gallus Gallus)
  misc_feature (36): n=a or t
cttcccattcatttacaattcacactgaagacattntgggctgtgaaagattttgcatgattttggacaag

SEQ ID NO: 48670 - DNA, 71 bp, chicken (Gallus Gallus)
  misc_feature (36): n=a or t
tcattttagttcatcatgagctgatacaggttaagnggtttcacgtcatgtgagaattagatacagcctag

SEQ ID NO: 48671 - DNA, 71 bp, chicken (Gallus Gallus)
  misc_feature (36): n=c or g
aatttgggcacgttcaacacaagtgggtttaagttnttcactgtggcttcaaaatttctctgtggaaatcc

SEQ ID NO: 48672 - DNA, 71 bp, chicken (Gallus Gallus)
  misc_feature (36): n=a or t
ttggctgatcatctgttttgtcagtatctcagtacngctcctttcaaccatatattttaaaccatttttct

SEQ ID NO: 48673 - DNA, 71 bp, chicken (Gallus Gallus)
  misc_feature (36): n=a or t
agcaaaaggagaactcacggagaccttcagtgtagntgcagctgaactttcaaggatttttcaacttcagt

SEQ ID NO: 48674 - DNA, 71 bp, chicken (Gallus Gallus)
  misc_feature (36): n=c or g
cttggatttgtcactataattatatacacgtatgtntgttttaggtagtgtcatcaggctgttcagtactt

SEQ ID NO: 48675 - DNA, 71 bp, chicken (Gallus Gallus)
  misc_feature (36): n=c or g
ttaaattatttggctgtgtctgtaacaagctatcantagttaaggtaaaggttgttcctagtaaacttgaa

SEQ ID NO: 48676 - DNA, 71 bp, chicken (Gallus Gallus)
  misc_feature (36): n=a or t
tttgatttctgttggtgatggtgctttataaccagngtagaagatgacaaagcttgtcttcagaattgcag

SEQ ID NO: 48677 - DNA, 71 bp, chicken (Gallus Gallus)
  misc_feature (36): n=a or t
ttgatctggaatctggtctccaagcaatgaaattgncagagggaaaaatgatggggaatttgcacacacaa

SEQ ID NO: 48678 - DNA, 71 bp, chicken (Gallus Gallus)
  misc_feature (36): n=c or g
aagttttatttgtgtactgttttccttgactctctnactgctcacctcatcaatccagaggcacatgagca

SEQ ID NO: 48679 - DNA, 71 bp, chicken (Gallus Gallus)
  misc_feature (36): n=a or t
caagggctgtattctggctagtactgagtgcatgcnactatcagtaaagggacatttgcaagtgtaattcc

SEQ ID NO: 48680 - DNA, 71 bp, chicken (Gallus Gallus)
  misc_feature (36): n=a or t
tatctactgcctagttgctgtcagaatagaacctangcaagatttgtgctgacaatctgctttcttaaccc

SEQ ID NO: 48681 - DNA, 71 bp, chicken (Gallus Gallus)
  misc_feature (36): n=a or t
aatcccaacttccatcaattaaaattgctttcagcnttctctgaaccatgtttatatacaccagtggcttg

SEQ ID NO: 48682 - DNA, 71 bp, chicken (Gallus Gallus)
  misc_feature (36): n=c or g
agccttggaccacaccagctcttccagtgctgctcntatggtgccaggccatgattcttggccatgaggaa

SEQ ID NO: 48683 - DNA, 71 bp, chicken (Gallus Gallus)
  misc_feature (36): n=c or g
acaacccactgagccaggcttcagccttcgtcaganagacacacggacaaggcctgaacttactcaacaaa

SEQ ID NO: 48684 - DNA, 71 bp, chicken (Gallus Gallus)
  misc_feature (36): n=a or t
taataaaaggtaaataaaaagccactacatttcatnggaacttaatcagtataggaagagctcataaggga

SEQ ID NO: 48685 - DNA, 71 bp, chicken (Gallus Gallus)
  misc_feature (36): n=c or g
tcctttttaatgccatgaaaatgccatgttcagtgntgccttcttttgtggtagatcttcactgctgcaaa

SEQ ID NO: 48686 - DNA, 71 bp, chicken (Gallus Gallus)
  misc_feature (36): n=a or t
aatgctacagttctgaaaccagagcatagtttggcntggaacaatatgattatattgctagataacacagg

SEQ ID NO: 48687 - DNA, 71 bp, chicken (Gallus Gallus)
  misc_feature (36): n=c or g
taatgggagaatctcctcctaactgagatcctatgncttaaactctactggcaagatctctggaagcttat

SEQ ID NO: 48688 - DNA, 71 bp, chicken (Gallus Gallus)
  misc_feature (36): n=c or g
agtccaaagtcaatgagcttaaagcactcctcctcngcgctccacaggatgttgcgtggcttcaggtctgc

SEQ ID NO: 48689 - DNA, 71 bp, chicken (Gallus Gallus)
  misc_feature (36): n=a or t
ataactttatgtacagaaaaagaatcactcagctgnatggagagctcaccaaatatttacactatgttaaa

SEQ ID NO: 48690 - DNA, 71 bp, chicken (Gallus Gallus)
  misc_feature (36): n=a or t
accctatttatagctgtatttctcctttgtcttgancttattctagaccttcttgaacaactttcagacgg

SEQ ID NO: 48691 - DNA, 71 bp, chicken (Gallus Gallus)
  misc_feature (36): n=c or g
acctttcacccacttcatttcccaggttcaactttntttctttactcttctactacctctaaccctgaggt

SEQ ID NO: 48692 - DNA, 71 bp, chicken (Gallus Gallus)
  misc_feature (36): n=c or g
gtagtgccttctaatttacttaaggtttaagatggncattttaagaaggattaattacacctatgcctgtg

SEQ ID NO: 48693 - DNA, 71 bp, chicken (Gallus Gallus)
  misc_feature (36): n=c or g
ctataaaaggaacgtcacttgcatttctcttctctnttaaagcaaaacgatggagcagaggaaggcacctt

SEQ ID NO: 48694 - DNA, 71 bp, chicken (Gallus Gallus)
  misc_feature (36): n=a or t
tcttatgggtacctcatggcgtgcatggttcaaacntgtgtgcggtcacaaaagctactgctataagccat

SEQ ID NO: 48695 - DNA, 71 bp, chicken (Gallus Gallus)
  misc_feature (36): n=c or g
attttctgtaagttccagtgactttgtttttgttcnttttgctttgtgtggaaagtgtatctgcatattta

SEQ ID NO: 48696 - DNA, 71 bp, chicken (Gallus Gallus)
  misc_feature (36): n=c or g
taaagggttattgataaaatgtgatgacagtttcantgttaatactgtgtgctctacctctgtgatcagaa

SEQ ID NO: 48697 - DNA, 71 bp, chicken (Gallus Gallus)
  misc_feature (36): n=a or t
tgactgtgcattttacatgttttgttaaactacacngttttataagtgctactttggcattactcttaagt

SEQ ID NO: 48698 - DNA, 71 bp, chicken (Gallus Gallus)
  misc_feature (36): n=a or t
tctggctgctcctgtgacacggatgtctctgaaccnatgctgtggttaacagagtggtgaaacaaaacatg

SEQ ID NO: 48699 - DNA, 71 bp, chicken (Gallus Gallus)
  misc_feature (36): n=c or g
tatctgaagatgattcaaagtaattcggatccaaancattgattcagcaccaaggaaatgactttgatggc

SEQ ID NO: 48700 - DNA, 71 bp, chicken (Gallus Gallus)
  misc_feature (36): n=c or g
caggcaatatcccccaacacaatccggcttttgaancaagagccaaaaatccccaaatgagcaaatgaggg

SEQ ID NO: 48701 - DNA, 71 bp, chicken (Gallus Gallus)
  misc_feature (36): n=a or t
cagcaatgctgtatgtataattaaatcaagatatcngactacatagatgttgcccataatatttggcagga

SEQ ID NO: 48702 - DNA, 71 bp, chicken (Gallus Gallus)
  misc_feature (36): n=a or t
aggctggaaggtccttcctgatactatattccagtncctaaactaaagtctgttaaaagttgtagtatgcc

SEQ ID NO: 48703 - DNA, 71 bp, chicken (Gallus Gallus)
  misc_feature (36): n=a or t
tgacttctctcatgccaacatccatccagaataacncaaccaattggaattatccctgaagcactggcagg

SEQ ID NO: 48704 - DNA, 71 bp, chicken (Gallus Gallus)
  misc_feature (36): n=c or g
gtcctacagcaataaattccttaagtgaatgtaganacaatggaattatttctcagtcccaggactgacaa

SEQ ID NO: 48705 - DNA, 71 bp, chicken (Gallus Gallus)
  misc_feature (36): n=c or g
cgttggctttggtttctccccatctctaatccaagngaagccgtagggttacatctctttataccaaactc

SEQ ID NO: 48706 - DNA, 71 bp, chicken (Gallus Gallus)
  misc_feature (36): n=c or g
aaaaagggtgtgtttcacatcaaagcctttggatgntgcaattgcctaactcaaactgtcttcacacatca

SEQ ID NO: 48707 - DNA, 71 bp, chicken (Gallus Gallus)
  misc_feature (36): n=a or t
ataaaactaaactgtatgggttactcagtaggaaantgttattttgagtcgtgaccgaacaggtggcattt

SEQ ID NO: 48708 - DNA, 71 bp, chicken (Gallus Gallus)
  misc_feature (36): n=a or t
cacacgcagctccctgttttggtgcagggtagggtntaagggcttccgcctgcagcagaagatgcccccag

SEQ ID NO: 48709 - DNA, 71 bp, chicken (Gallus Gallus)
  misc_feature (36): n=c or g
tctttccttccgttcaagtggcagtggggctgctgnagagggtcaaaggaaatgcaggggctgggtgagag

SEQ ID NO: 48710 - DNA, 71 bp, chicken (Gallus Gallus)
  misc_feature (36): n=c or g
aaatttaaacactttcagcttcttcaggaagaaaangatgagagactcccttcaagttcagatctttcatt

SEQ ID NO: 48711 - DNA, 71 bp, chicken (Gallus Gallus)
  misc_feature (36): n=c or g
gacgtgcctttgtgacagacttggaaagggactatntagtgagtctgcctgtcatagagagaaaaggtaat

SEQ ID NO: 48712 - DNA, 71 bp, chicken (Gallus Gallus)
  misc_feature (36): n=c or g
agctccagctctgctgcaagagcggtgctggagcantgctgtaagatgggagatgtgtaagatatggggca

SEQ ID NO: 48713 - DNA, 71 bp, chicken (Gallus Gallus)
  misc_feature (36): n=c or g
aacaggtgtgcataaaaacagtagcctcatagaganaaagctaataaaaagttaaattccacaacaacttt

SEQ ID NO: 48714 - DNA, 71 bp, chicken (Gallus Gallus)
  misc_feature (36): n=a or t
caacaaacagcacatcacagtatgactgcatatagnaagagattgtaatagtctaagatgcaagatggaaa

SEQ ID NO: 48715 - DNA, 71 bp, chicken (Gallus Gallus)
  misc_feature (36): n=c or g
agtgttatgctacatctagaatatatctttcacctntatcttccaccttatctaccatctgttaataagtg

SEQ ID NO: 48716 - DNA, 71 bp, chicken (Gallus Gallus)
  misc_feature (36): n=a or t
agaaagcagacaaaacacgtaggatcccacacagcnagtcacaaatggggtcccagttcggtaattgcttt

SEQ ID NO: 48717 - DNA, 71 bp, chicken (Gallus Gallus)
  misc_feature (36): n=c or g
agttttctctgctcacccttacaaatatcaaccacntgcacattgccatggtgctgtaggacagcctgaac

SEQ ID NO: 48718 - DNA, 71 bp, chicken (Gallus Gallus)
  misc_feature (36): n=c or g
ggctccttcgttagtgtatgctggggactgttccanctttccaactggcctagaatatctcagctggccaa

SEQ ID NO: 48719 - DNA, 71 bp, chicken (Gallus Gallus)
  misc_feature (36): n=c or g
caaaacacatggatgcaagtgatgtatgttgctgangatactgtagatgtgaatgaaaatcagtttggaag

SEQ ID NO: 48720 - DNA, 71 bp, chicken (Gallus Gallus)
  misc_feature (36): n=c or g
aaaggaccaattactaggtctggctaaatagggtgnaaatctcttttttattatcaagttttctgctttct

SEQ ID NO: 48721 - DNA, 71 bp, chicken (Gallus Gallus)
  misc_feature (36): n=a or t
aagaaaccagtagcaggtaagcagagctcttcttanttctgttctgtggccttttgttcagagaaggttaa

SEQ ID NO: 48722 - DNA, 71 bp, chicken (Gallus Gallus)
  misc_feature (36): n=c or g
gagtttctgggagagaaaatgcagagaaagcgtaanggactgctctcacaagcagagatgtgtgtaacgca

SEQ ID NO: 48723 - DNA, 71 bp, chicken (Gallus Gallus)
  misc_feature (36): n=a or t
ggaatcctgaaggccggtgataaaaatcagaaggcnatatgagtaagaagaaaaggtaatgagatgagaac

SEQ ID NO: 48724 - DNA, 71 bp, chicken (Gallus Gallus)
  misc_feature (36): n=c or g
ttgcgttttacaagaaaaatgattactcatttcttntagatcagtacatatgcgggttactctaacaaaac

SEQ ID NO: 48725 - DNA, 71 bp, chicken (Gallus Gallus)
  misc_feature (36): n=c or g
taacctcattgttctgttgaaacatgacccaggganatattacactgctctggggctttctaaaaagtcaa

SEQ ID NO: 48726 - DNA, 71 bp, chicken (Gallus Gallus)
  misc_feature (36): n=c or g
ttctgtacgggcttaaccagacggttttctgtatgntttgaatttacacggagcacacaagagcaaaaagc

SEQ ID NO: 48727 - DNA, 71 bp, chicken (Gallus Gallus)
  misc_feature (36): n=c or g
ttctcactcagatatttggaatcacatgtagacttnctgaagctgatatatttattggcatagtcaggtat

SEQ ID NO: 48728 - DNA, 71 bp, chicken (Gallus Gallus)
  misc_feature (36): n=a or t
cttgtgttttcagatcaggacatcattaactttgtnccaatgttccaacagcacatttaactacactggta

SEQ ID NO: 48729 - DNA, 71 bp, chicken (Gallus Gallus)
  misc_feature (36): n=c or g
tttaggcttggcaatggggaaaatatgttactgaanagcacaacacaggttttatagtcaatggagttctc

SEQ ID NO: 48730 - DNA, 71 bp, chicken (Gallus Gallus)
  misc_feature (36): n=a or t
tctgtgtttgtctttcataattattgcactctaacnatggaagaaaagggattcaatcttcattgaaaacg

SEQ ID NO: 48731 - DNA, 71 bp, chicken (Gallus Gallus)
  misc_feature (36): n=a or t
tccttcagtgtattttcattagtctaggatgggttnattcagctcaatccttagatattaactgtgtttta

SEQ ID NO: 48732 - DNA, 71 bp, chicken (Gallus Gallus)
  misc_feature (36): n=a or t
ctccgctgcctccttcaaaaagtaacaggtcgaacnacaaatttttacagatagggtctccaaaagacagc

SEQ ID NO: 48733 - DNA, 71 bp, chicken (Gallus Gallus)
  misc_feature (36): n=c or g
tttgaaagactttagacatctgcattatgttagttnttaattagaaggtacaattattatctttgagacag

SEQ ID NO: 48734 - DNA, 71 bp, chicken (Gallus Gallus)
  misc_feature (36): n=a or t
acagtgatgagaaatactatctgtgttagtaggacntatgacttacagttctttcttctcaggtctcctgt

SEQ ID NO: 48735 - DNA, 71 bp, chicken (Gallus Gallus)
  misc_feature (36): n=c or g
aaactggtgtggaaccatagcctggagaagtcacanctgaatacgtttgctcaccttgcactcataccaat

SEQ ID NO: 48736 - DNA, 71 bp, chicken (Gallus Gallus)
  misc_feature (36): n=a or t
acattattacttgaaagaatgaacatatgaatttanatcttccccatcttgtcccacttagtgggttctga

SEQ ID NO: 48737 - DNA, 71 bp, chicken (Gallus Gallus)
  misc_feature (36): n=c or g
aagatttttccactaaggagaaaatggccaatgaantggggtgagtgctggaggcttgaaaacagggaact

SEQ ID NO: 48738 - DNA, 71 bp, chicken (Gallus Gallus)
  misc_feature (36): n=a or t
gtgtccctagtggtaaaaacagttatgcaactaaantgcacctaattttgaccacaggctatttttactgc

SEQ ID NO: 48739 - DNA, 71 bp, chicken (Gallus Gallus)
  misc_feature (36): n=a or t
tggacatactgacattagctgtgctgcagtgattanattttatgtggctgctttagtaatcaattctttga

SEQ ID NO: 48740 - DNA, 71 bp, chicken (Gallus Gallus)
  misc_feature (36): n=a or t
catgtcctctgcagcgacatcactcgtttcagtccncgaagcgtatcgtgttgcactgtcacttagaactt

SEQ ID NO: 48741 - DNA, 71 bp, chicken (Gallus Gallus)
  misc_feature (36): n=a or t
atgaaacaaccactctctttttatgcttaacctatnagactatagttgtattctagaagaggtttcttcta

SEQ ID NO: 48742 - DNA, 71 bp, chicken (Gallus Gallus)
  misc_feature (36): n=a or t
tgtctgatctctttgttcagctcatattttttcatncatctatctcacttcattaagttctgaagctgttg

SEQ ID NO: 48743 - DNA, 71 bp, chicken (Gallus Gallus)
  misc_feature (36): n=a or t
tggaccaaaaattatctgggataaaactaacaaagnaaagaggagatagttttaacccagatcaatccccc

SEQ ID NO: 48744 - DNA, 71 bp, chicken (Gallus Gallus)
  misc_feature (36): n=c or g
cctgacttttctcaattatattcatacttgagagangattacagttcattctcaagacaaatcaaaatatg

SEQ ID NO: 48745 - DNA, 71 bp, chicken (Gallus Gallus)
  misc_feature (36): n=c or g
gtttctgcattagaaaccgaaaagggggaactgatntgaagaagcagagcacggcctattagtgttttgta

SEQ ID NO: 48746 - DNA, 71 bp, chicken (Gallus Gallus)
  misc_feature (36): n=a or t
ttcaccatggtgggacagctgtagtaccactgacangtcctcattcaaagaacctgcggtgcactttcact

SEQ ID NO: 48747 - DNA, 71 bp, chicken (Gallus Gallus)
  misc_feature (36): n=a or t
ctaatttgaccaggagcatagtccatcgcgctgagngcatttatctgagcaaggtaaaacttgggagatag

SEQ ID NO: 48748 - DNA, 71 bp, chicken (Gallus Gallus)
  misc_feature (36): n=a or t
gaggcagaaagtctccatgcttcactgaggacagantcctaactatgatgatgcctttctagcctggcaaa

SEQ ID NO: 48749 - DNA, 71 bp, chicken (Gallus Gallus)
  misc_feature (36): n=a or t
ttgctgaatttagataagctatctgttgggaattantcaacatgaaatgtatcgttttattctaccacata

SEQ ID NO: 48750 - DNA, 71 bp, chicken (Gallus Gallus)
  misc_feature (36): n=a or t
ttttaggacagaaaaggcagtttgaatattgtttcntaaatacatacttttgctgttgtagagtatggcag

SEQ ID NO: 48751 - DNA, 71 bp, chicken (Gallus Gallus)
  misc_feature (36): n=a or t
gttcctagtgcttaatctcatcagggaataattatntaagaaacaggtattttgtaacttaacactctaag

SEQ ID NO: 48752 - DNA, 71 bp, chicken (Gallus Gallus)
  misc_feature (36): n=a or t
tagtgttgtgtgtctgcacttttggcacatgggttnttaagtatgcttctccagtcttggtaggagaagta

SEQ ID NO: 48753 - DNA, 71 bp, chicken (Gallus Gallus)
  misc_feature (36): n=c or g
acttcccatacaaagctctgaagctctcttactttnaaaaggaatgctgactcatgctgtcacagctcatg

SEQ ID NO: 48754 - DNA, 71 bp, chicken (Gallus Gallus)
  misc_feature (36): n=c or g
aaatacctgcctctctaactaatcaaatgaagtctncagggattacactgctaatttactcaatataaaaa

SEQ ID NO: 48755 - DNA, 71 bp, chicken (Gallus Gallus)
  misc_feature (36): n=a or t
atgtactggagaagtatgtctagacaatggcagttngtgtagtttctgcttcaaaatggtgattcctttgc

SEQ ID NO: 48756 - DNA, 71 bp, chicken (Gallus Gallus)
  misc_feature (36): n=a or t
attcactctgggctttgagttgttggctttggcgtnctgtttttacatcattactttttctttcaagatga

SEQ ID NO: 48757 - DNA, 71 bp, chicken (Gallus Gallus)
  misc_feature (36): n=a or t
gaagtgatagatctcacaggcttggaaatcaagacnttggacatcatgacttcaggaagcaggagggttag

SEQ ID NO: 48758 - DNA, 71 bp, chicken (Gallus Gallus)
  misc_feature (36): n=a or t
atctaacatcactgttgtctttactattcctgtttnatgaataagctaataaagcaagtagttgttttttt

SEQ ID NO: 48759 - DNA, 71 bp, chicken (Gallus Gallus)
  misc_feature (36): n=a or t
agcgttaatgtgcttgagttgccaagtctatggatnaaacaatggatgggagcttattttgaaataacatc

SEQ ID NO: 48760 - DNA, 71 bp, chicken (Gallus Gallus)
  misc_feature (36): n=a or t
acactggggagcaacaaaacacaaacttccttgatntgactaagatccccactatactcaaagcagggcag

SEQ ID NO: 48761 - DNA, 71 bp, chicken (Gallus Gallus)
  misc_feature (36): n=c or g
agctgcagagtgccaaaatcaagacaaaatcaaaantctttactcagtaccagataaatccttctgtgtgt

SEQ ID NO: 48762 - DNA, 71 bp, chicken (Gallus Gallus)
  misc_feature (36): n=c or g
aaatcctctcctttagaggaaaacacagatcgcacntacttgactttgcttcctgtgagaattcagaaacc

SEQ ID NO: 48763 - DNA, 71 bp, chicken (Gallus Gallus)
  misc_feature (36): n=c or g
agtgctcccaaaaagcagtagctgcacaggagcttncacaaatcatgctgagatcacacacagagactcag

SEQ ID NO: 48764 - DNA, 71 bp, chicken (Gallus Gallus)
  misc_feature (36): n=c or g
gtaccacagaattagtgtgctccaaactttgggctntacctcctggccagggatgaaatctgcctccaggc

SEQ ID NO: 48765 - DNA, 71 bp, chicken (Gallus Gallus)
  misc_feature (36): n=c or g
ctatttccatatgtgttaattgtgttaaccaattangctttttagtgaagactggagagataaaaaataaa

SEQ ID NO: 48766 - DNA, 71 bp, chicken (Gallus Gallus)
  misc_feature (36): n=c or g
ctgagacttcagagaggtttggggttggtttcctgnccggaggggtcgcgccccacataccgcccatagag

SEQ ID NO: 48767 - DNA, 71 bp, chicken (Gallus Gallus)
  misc_feature (36): n=a or t
taccaaacagatggatccaagcttttagcactttangcgtgtcctgcattgatctggtgacctgggggcaa

SEQ ID NO: 48768 - DNA, 71 bp, chicken (Gallus Gallus)
  misc_feature (36): n=a or t
gaaaaaaaaatctaagaacatcttgatccaaagggnagttctaaaggattctggaatttaagagtcacaca

SEQ ID NO: 48769 - DNA, 71 bp, chicken (Gallus Gallus)
  misc_feature (36): n=c or g
ctgatgcattgctgaaattggaatgcggttttgctntctgtcctggccttgttcatttaactttcagctcg

SEQ ID NO: 48770 - DNA, 71 bp, chicken (Gallus Gallus)
  misc_feature (36): n=c or g
ggaacggactccactcttcggagcacccgagttttncagagataagatgagaacaaggctctcttatctgt

SEQ ID NO: 48771 - DNA, 71 bp, chicken (Gallus Gallus)
  misc_feature (36): n=c or g
agtaggttggccaaggaggagtcagccttttgaaantgggatgctgcacattaaagaaggtaagttcaacc

SEQ ID NO: 48772 - DNA, 71 bp, chicken (Gallus Gallus)
  misc_feature (36): n=c or g
aatggcattttaggaaggtgatggcttcagaggaanggtcttagcttgaaacatacaggagtataactgga

SEQ ID NO: 48773 - DNA, 71 bp, chicken (Gallus Gallus)
  misc_feature (36): n=a or t
gtgttcaaggcatatcgtgattgcatttgttcagcntgtaaattaaggaaatatagaaaactttggaagaa

SEQ ID NO: 48774 - DNA, 71 bp, chicken (Gallus Gallus)
  misc_feature (36): n=c or g
tcctcatagctggaacacttacgtgcttagcactgntgggtacctaaggctttggggaggagattttcagg

SEQ ID NO: 48775 - DNA, 71 bp, chicken (Gallus Gallus)
  misc_feature (36): n=a or t
aaatgcagctgaaagaggactgtctacatcatactntactgaactactgaaatagcccaagggaactgaag

SEQ ID NO: 48776 - DNA, 71 bp, chicken (Gallus Gallus)
  misc_feature (36): n=c or g
tcagaggaaaagcagtgaagagaaaagtcagacgantgagggacttctagaaaggaacaggtatcccaggt

SEQ ID NO: 48777 - DNA, 71 bp, chicken (Gallus Gallus)
  misc_feature (36): n=c or g
ccaccaaatacactggatgagcttatagatgaactnggtggtcctgaaaatgttgcagaggtaggctgatg

SEQ ID NO: 48778 - DNA, 71 bp, chicken (Gallus Gallus)
  misc_feature (36): n=c or g
caacactggccacgctgcagcagaacagaggcctgnatatcccaacatcttctccctcgcagtgcctgaaa

SEQ ID NO: 48779 - DNA, 71 bp, chicken (Gallus Gallus)
  misc_feature (36): n=c or g
ctttttttttcttcattagcttccttcacaatctcncttcgtgcagcggacaacatcacagttacaattaa

SEQ ID NO: 48780 - DNA, 71 bp, chicken (Gallus Gallus)
  misc_feature (36): n=c or g
atgagtaggtggtgtaaatgttagcattccacattngggcatggctgtgaaacgtttcagtgagccttggc

SEQ ID NO: 48781 - DNA, 71 bp, chicken (Gallus Gallus)
  misc_feature (36): n=a or t
cctcagctttttccttactctgatatttaactgttncccaactcacatagactacagtttcatcctccctc

SEQ ID NO: 48782 - DNA, 71 bp, chicken (Gallus Gallus)
  misc_feature (36): n=a or t
gccaagacacccctacttcttgcagcactcccaggngaatattttttgatcacatcatatttgaaaaatag

SEQ ID NO: 48783 - DNA, 71 bp, chicken (Gallus Gallus)
  misc_feature (36): n=c or g
atgctgatagcctttctctctggccttgtgaaacgngaggaaaatttaatagtgctgacataagcggtttt

SEQ ID NO: 48784 - DNA, 71 bp, chicken (Gallus Gallus)
  misc_feature (36): n=a or t
acctctgtaacagaatacagatcagaggtctctaangtgctcaagtttacatcacgtcttaataccctaag

SEQ ID NO: 48785 - DNA, 71 bp, chicken (Gallus Gallus)
  misc_feature (36): n=a or t
tctatgcatattcgaacacagttaaagtaacaccanaataaaaattatcttctgtgcctggcagtagatgc

SEQ ID NO: 48786 - DNA, 71 bp, chicken (Gallus Gallus)
  misc_feature (36): n=c or g
catgtagtgggggcaaatactcttctttgtggtctnaaactgcaggatcaaagtcagacaaaggacagaaa

SEQ ID NO: 48787 - DNA, 71 bp, chicken (Gallus Gallus)
  misc_feature (36): n=c or g
tactttcagtataactccaacctatttcagtagatnagtatgccacagaactacttgcaaatgagaacagc

SEQ ID NO: 48788 - DNA, 71 bp, chicken (Gallus Gallus)
  misc_feature (36): n=a or t
tgaagatgcagtggaaggggggaccgatgctgttgnacctctccagggagctgttggatctgatctcatag

SEQ ID NO: 48789 - DNA, 71 bp, chicken (Gallus Gallus)
  misc_feature (36): n=a or t
attaagatctacagccttaagaaattatctgtttgnttgagatacagtaaaaataaaacattttgaaacag

SEQ ID NO: 48790 - DNA, 71 bp, chicken (Gallus Gallus)
  misc_feature (36): n=a or t
tgtattttttatgaatgtgaaagcaacaagcccagntcttgaaccctgtttatacaaaccagggatgcaaa

SEQ ID NO: 48791 - DNA, 71 bp, chicken (Gallus Gallus)
  misc_feature (36): n=a or t
tctcaagaaaacaatgcagtatcttaacctcttgcngtgtataggaaaataagttgctaatttgtaatcct

SEQ ID NO: 48792 - DNA, 71 bp, chicken (Gallus Gallus)
  misc_feature (36): n=c or g
ataatgagtattctgactattcctgaaggagatctnttaggacaggctgttttacaactgtaggatgtgct

SEQ ID NO: 48793 - DNA, 71 bp, chicken (Gallus Gallus)
  misc_feature (36): n=a or t
tttctctcaccaactacattggaaatagaaatgcancttttgaatgttgtgcattcttaatcactgttttg

SEQ ID NO: 48794 - DNA, 71 bp, chicken (Gallus Gallus)
  misc_feature (36): n=a or t
ttacatcaatccttatgtaggtcacccaaatcagangagaaagaaagcattctgacaaaggtctgtgaggt

SEQ ID NO: 48795 - DNA, 71 bp, chicken (Gallus Gallus)
  misc_feature (36): n=c or g
cgtctcctgcctgaggtctacatgttctgtctgganggaagggatttgcccagtgagctcagtatctcctc

SEQ ID NO: 48796 - DNA, 71 bp, chicken (Gallus Gallus)
  misc_feature (36): n=c or g
atgacaagggcagtccgagcacagcatgtggatggntttctctggattcgaggctctacaaatcaacagaa

SEQ ID NO: 48797 - DNA, 71 bp, chicken (Gallus Gallus)
  misc_feature (36): n=a or t
agagctattgtttcagatcttgagatcctctgaagntttctgcacatcaatccatcaagtaggctaaagga

SEQ ID NO: 48798 - DNA, 71 bp, chicken (Gallus Gallus)
  misc_feature (36): n=c or g
cataattttaatagagagagtcaacaaatgtgaaantgagtgcaataaacttggtgcgaggctaaagaagg

SEQ ID NO: 48799 - DNA, 71 bp, chicken (Gallus Gallus)
  misc_feature (36): n=c or g
gaggggaccacgagaggacagccgctccattcatanaacggcatagcagacatagaatcacggagtggctg

SEQ ID NO: 48800 - DNA, 71 bp, chicken (Gallus Gallus)
  misc_feature (36): n=a or t
attaaaattattgtccagtaacagtgcctggagtangttgtgttgactttaaatacaatgaacatcctgtg

SEQ ID NO: 48801 - DNA, 71 bp, chicken (Gallus Gallus)
  misc_feature (36): n=a or t
gcaattttttaatggagtacaatttctgaccatacngcttccatgctaacacaaaagaacaacttctgcta

SEQ ID NO: 48802 - DNA, 71 bp, chicken (Gallus Gallus)
  misc_feature (36): n=a or t
atcgactcagttcatgacactgctagtcatttagtncatttttcacctaaagcaggagtgtccaacccgtg

SEQ ID NO: 48803 - DNA, 71 bp, chicken (Gallus Gallus)
  misc_feature (36): n=a or t
aacaaaagcgatgcctgagcagtaagtatcttttcnatgtcactttaaaagctatacaatcttatctagat

SEQ ID NO: 48804 - DNA, 71 bp, chicken (Gallus Gallus)
  misc_feature (36): n=c or g
acatagaaatcagacttcctttgacagctcttgganagccataggatttcagatggcttaggggtgggcag

SEQ ID NO: 48805 - DNA, 71 bp, chicken (Gallus Gallus)
  misc_feature (36): n=a or t
cctgttgatatttctacccagacaaaaagatcaagnttgttaaaattacagtgtcttttagaaagctcatg

SEQ ID NO: 48806 - DNA, 71 bp, chicken (Gallus Gallus)
  misc_feature (36): n=a or t
atcacattattcattatgatttgtccatacttctantagtatggatatatgaatgcagtgagagtaatttg

SEQ ID NO: 48807 - DNA, 71 bp, chicken (Gallus Gallus)
  misc_feature (36): n=c or g
tgttgttgccactttacagaagtgaaatggaatctnccaaatggctgctcaaggtctgaattctcttattt

SEQ ID NO: 48808 - DNA, 71 bp, chicken (Gallus Gallus)
  misc_feature (36): n=a or t
tgtttgtttcatcctagctacaatatttctctaagncattttagactagttgttctcaaaaacagaagaaa

SEQ ID NO: 48809 - DNA, 71 bp, chicken (Gallus Gallus)
  misc_feature (36): n=a or t
caaacatctccctggaaaatccagactcaatctacntgtgttaacacagctaaagtcatgaacgagcctgt

SEQ ID NO: 48810 - DNA, 71 bp, chicken (Gallus Gallus)
  misc_feature (36): n=a or t
tgtaatgtgtgcaatttctctgcagatttgacatcncgagattagaaattcccaaacccagtaatctggac

SEQ ID NO: 48811 - DNA, 71 bp, chicken (Gallus Gallus)
  misc_feature (36): n=a or t
cagaggaagatgatggcaaagatgtcactggccacnggagtttgcactgttttaccacccaacagtttttc

SEQ ID NO: 48812 - DNA, 71 bp, chicken (Gallus Gallus)
  misc_feature (36): n=a or t
agaggtaaaaataaaacccttctccttttggactanaaacagcttaagaccaaaataacctattcaatttt

SEQ ID NO: 48813 - DNA, 71 bp, chicken (Gallus Gallus)
  misc_feature (36): n=a or t
atgcttcccacttccaaagcaaaaggggatctcagnctggaatgatgatttcaacaagatagacttttaaa

SEQ ID NO: 48814 - DNA, 71 bp, chicken (Gallus Gallus)
  misc_feature (36): n=c or g
cttcttcatcaggaactgctgacccatctcaccgcnaaaggattatgtaagcagtgcttttctcaccactt

SEQ ID NO: 48815 - DNA, 71 bp, chicken (Gallus Gallus)
  misc_feature (36): n=a or t
gtaaaggttatatgacctgtcttgtcaatgtaactnttgttggatgggatctaaaagaggtggtgcttgca

SEQ ID NO: 48816 - DNA, 71 bp, chicken (Gallus Gallus)
  misc_feature (36): n=a or t
atttgtaaagcagtgtgctcttcaggacacaaactntaccttctttttgaagcaccttgtataccacaagt

SEQ ID NO: 48817 - DNA, 71 bp, chicken (Gallus Gallus)
  misc_feature (36): n=a or t
aaccaacagcaggtccagagtgtccattagcctacngcccgctaacgaggacatctgaggctgacacactg

SEQ ID NO: 48818 - DNA, 71 bp, chicken (Gallus Gallus)
  misc_feature (36): n=a or t
tgtggtggcagtacttgaagccactccgcatgctcnactcagtgtctcctagtatttctgtactactgtta

SEQ ID NO: 48819 - DNA, 71 bp, chicken (Gallus Gallus)
  misc_feature (36): n=c or g
tgttccattaagcttgtatcatattgtcagcacttncccatatggaaaacatataaattgtcatgaaaaca

SEQ ID NO: 48820 - DNA, 71 bp, chicken (Gallus Gallus)
  misc_feature (36): n=a or t
aaacactaaaatttaatgctgaaagaagatgattcnttacagtgatataaagcaaaaaaagaagtttgcat

SEQ ID NO: 48821 - DNA, 71 bp, chicken (Gallus Gallus)
  misc_feature (36): n=a or t
gcaatggtaattctaaccaaaagggtagtaccattntctgggaatattcagggaaatgtaaggaaaatcac

SEQ ID NO: 48822 - DNA, 71 bp, chicken (Gallus Gallus)
  misc_feature (36): n=a or t
aattctcaaaacatcagccgcagcctgcatcctgcntcactacactcctctcctacagcaggagtaatgga

SEQ ID NO: 48823 - DNA, 71 bp, chicken (Gallus Gallus)
  misc_feature (36): n=a or t
agttttcagtctgtgtggaatagagtaggaaaaaantcctgtgtgatacaacttaatagcgtaggaaatga

SEQ ID NO: 48824 - DNA, 71 bp, chicken (Gallus Gallus)
  misc_feature (36): n=c or g
aacatcaaatgtactgttccctattcactttctcantgtcacttatggatctgctctatcagattccactc

SEQ ID NO: 48825 - DNA, 71 bp, chicken (Gallus Gallus)
  misc_feature (36): n=c or g
cttctctattcccagcaagcaacagcaggtgtgctntgctatttgcattaccccccaactttaccaacgtc

SEQ ID NO: 48826 - DNA, 71 bp, chicken (Gallus Gallus)
  misc_feature (36): n=c or g
gaaaaaagcattgttagccgtgtgaccacaagcctnggaagcgcagagcagacagctctgctggagttgtt

SEQ ID NO: 48827 - DNA, 71 bp, chicken (Gallus Gallus)
  misc_feature (36): n=a or t
tgggtatttaaggttgatggatgtaaagctaagaanatctgaatgttcttaatatcagtcaacacagttag

SEQ ID NO: 48828 - DNA, 71 bp, chicken (Gallus Gallus)
  misc_feature (36): n=c or g
ttttgaagtacttcagtgttgttgattgcaaggttnctttccttgcttttcatgctcctaatcaaaagaca

SEQ ID NO: 48829 - DNA, 71 bp, chicken (Gallus Gallus)
  misc_feature (36): n=a or t
atctcagctaccatgcaagtagttaatgctctggtntcgttaacagtcagtaggtgtttggctgaatatat

SEQ ID NO: 48830 - DNA, 71 bp, chicken (Gallus Gallus)
  misc_feature (36): n=c or g
gcattgataaagggatgacaggatttgaactgcccnaaggacatggatcttccagtactctgctgaccatg

SEQ ID NO: 48831 - DNA, 71 bp, chicken (Gallus Gallus)
  misc_feature (36): n=a or t
tctctaaggatctggtcctggggaagatgaaaatanagcttacttttagccaagaggcaaaaggaaaactc

SEQ ID NO: 48832 - DNA, 71 bp, chicken (Gallus Gallus)
  misc_feature (36): n=a or t
cctaccagttgctaatcagacttcaagatctgacantcaagccttgaaaataatgcatcaatcattaataa

SEQ ID NO: 48833 - DNA, 71 bp, chicken (Gallus Gallus)
  misc_feature (36): n=c or g
caaatcaaaaaaagtcacacagtctactttaataangtgtactggatttgatgggtggaataaagagaatg

SEQ ID NO: 48834 - DNA, 71 bp, chicken (Gallus Gallus)
  misc_feature (36): n=c or g
tcgagggagaggcctgtgctcagtgaaccctcttanatcctgggaggtggtgtgaaatagagcaatggttc

SEQ ID NO: 48835 - DNA, 71 bp, chicken (Gallus Gallus)
  misc_feature (36): n=a or t
atgtgccattccgagcgagcaggatgctaaacacanatctcctggtttcttctcaatgctgagatatgaga

SEQ ID NO: 48836 - DNA, 71 bp, chicken (Gallus Gallus)
  misc_feature (36): n=c or g
cacagctgggggagaagagaattaagaagacttctnctgagtttcctcatcacatattctttaagtataac

SEQ ID NO: 48837 - DNA, 71 bp, chicken (Gallus Gallus)
  misc_feature (36): n=a or t
tcagcatttattacacagttctcagcataaacatanaaataagtgaatacactgcatggtagatgaacacc

SEQ ID NO: 48838 - DNA, 71 bp, chicken (Gallus Gallus)
  misc_feature (36): n=c or g
tctcatgaaaggaaactacggacacaaagaaggcangcaaggcagagttcagtgcaaaccctcagagatta

SEQ ID NO: 48839 - DNA, 71 bp, chicken (Gallus Gallus)
  misc_feature (36): n=c or g
tgtcgaagcagggattaatctgtggtctaactgaanaactgaaaagttgtaggggaagttctgttgcaggg

SEQ ID NO: 48840 - DNA, 71 bp, chicken (Gallus Gallus)
  misc_feature (36): n=c or g
cagcaaggagcagagccctgggagccaggctgctgnttgtgctctggctctcatcagcacagtagaggcaa

SEQ ID NO: 48841 - DNA, 71 bp, chicken (Gallus Gallus)
  misc_feature (36): n=a or t
agacccaaaatgccttatttatgccagattagagtnaaaaggaataattagttgccctgagacacaaggaa

SEQ ID NO: 48842 - DNA, 71 bp, chicken (Gallus Gallus)
  misc_feature (36): n=c or g
ttctgtgttccttttccatcactctggaggggaacntctctgtcattccagcaggccttacaaaagcacta

SEQ ID NO: 48843 - DNA, 71 bp, chicken (Gallus Gallus)
  misc_feature (36): n=c or g
tgtgcctttagcagctgagcaaggagttcctttagnagagttagccctctgcagaagaggagtaaaatgag

SEQ ID NO: 48844 - DNA, 71 bp, chicken (Gallus Gallus)
  misc_feature (36): n=a or t
aaaaaactatattaacaggataaagtagaattaatnattttatttcctattagtgttcatataacttaatc

SEQ ID NO: 48845 - DNA, 71 bp, chicken (Gallus Gallus)
  misc_feature (36): n=a or t
tatattttctcttgcagcagctgcctacacaattanataagaaatacaggtgaacagatatgaatttaata

SEQ ID NO: 48846 - DNA, 71 bp, chicken (Gallus Gallus)
  misc_feature (36): n=c or g
tagagctgggtgagctcagggctgagccccaggctnttgtgctctgagcccttggagcgttgctctttgga

SEQ ID NO: 48847 - DNA, 71 bp, chicken (Gallus Gallus)
  misc_feature (36): n=a or t
agtgtaaaagcatgaaagaattctgacctcagctgntgcttaaaagctgtgcatactgtgaggactgtgtg

SEQ ID NO: 48848 - DNA, 71 bp, chicken (Gallus Gallus)
  misc_feature (36): n=a or t
cgttgcccagattcatccaaagcctatattatactnttcctgaaaatgcggaaaccattctctaataatta

SEQ ID NO: 48849 - DNA, 71 bp, chicken (Gallus Gallus)
  misc_feature (36): n=a or t
aagggagaaatgtatgcaattataccagtccacatncagaaaaaccacagtgttaaatactgttaatattt

SEQ ID NO: 48850 - DNA, 71 bp, chicken (Gallus Gallus)
  misc_feature (36): n=c or g
ggccctcagaggtcccttctaactctaaggattctntgattctatgacggtttatcctaacctgctgtttt

SEQ ID NO: 48851 - DNA, 71 bp, chicken (Gallus Gallus)
  misc_feature (36): n=c or g
aaagtattcacactgcttagttataagagtacacantacatagcagtctacttcatgtgaggcaggaaagc

SEQ ID NO: 48852 - DNA, 71 bp, chicken (Gallus Gallus)
  misc_feature (36): n=c or g
attttttacattattacactgtcttagattgaaaanacctacttacctaacaaacagttaggtttccaata

SEQ ID NO: 48853 - DNA, 71 bp, chicken (Gallus Gallus)
  misc_feature (36): n=a or t
tatggaattttgcaaagctttatgaacactccaggntgatcagtaatacagactgaatgctgttttttaaa

SEQ ID NO: 48854 - DNA, 71 bp, chicken (Gallus Gallus)
  misc_feature (36): n=c or g
gacactgtaatgtgttttattgaaagatgagtccangacatagattcataaattcagtttccttggagact

SEQ ID NO: 48855 - DNA, 71 bp, chicken (Gallus Gallus)
  misc_feature (36): n=a or t
ccacagcgacctgctgccatgagtcatgcactgctnatgctccagagctgaagaaccttcctgcagcatgt

SEQ ID NO: 48856 - DNA, 71 bp, chicken (Gallus Gallus)
  misc_feature (36): n=c or g
ctttgatgtaccaagactagctggtacattttagtncaacctatgccatacttatatatgtttacttttgt

SEQ ID NO: 48857 - DNA, 71 bp, chicken (Gallus Gallus)
  misc_feature (36): n=a or t
atttccatcaacaagtacgtttgtagcaattgaaangcatttaaggatttggagacatcagagtatgattc

SEQ ID NO: 48858 - DNA, 71 bp, chicken (Gallus Gallus)
  misc_feature (36): n=c or g
ctacccctctcatactcctccagctcagctcagganttcccttttcccagcaactgggaagtgtcatcagt

SEQ ID NO: 48859 - DNA, 71 bp, chicken (Gallus Gallus)
  misc_feature (36): n=c or g
aacgaatacaacatttaactagagttagcctcgcangaaaaaaacaggaagatcattttaggttaattaag

SEQ ID NO: 48860 - DNA, 71 bp, chicken (Gallus Gallus)
  misc_feature (36): n=c or g
ttccgcattaaattaggaggtttatgtatgcttcanatgggcctcaatctggctccagtttcctgggttga

SEQ ID NO: 48861 - DNA, 71 bp, chicken (Gallus Gallus)
  misc_feature (36): n=a or t
tgtactttagatttctgtgcaagatgactgttaggntatggtaactttaccgggtattttgtaaaatgcac

SEQ ID NO: 48862 - DNA, 71 bp, chicken (Gallus Gallus)
  misc_feature (36): n=c or g
cctgcacatttgtttcctccaaaatcatattacggncatcagtgctgtgaccaaatccttggctttggcag

SEQ ID NO: 48863 - DNA, 71 bp, chicken (Gallus Gallus)
  misc_feature (36): n=a or t
cacctacaacatcagaaccttacctccttttaccanattatgactatttttattctatacttgcaagcata

SEQ ID NO: 48864 - DNA, 71 bp, chicken (Gallus Gallus)
  misc_feature (36): n=c or g
ctgagttggttttatattgtctgaaattcctctttnatgtcggttttgcttgagcgattaattcagatttt

SEQ ID NO: 48865 - DNA, 71 bp, chicken (Gallus Gallus)
  misc_feature (36): n=c or g
aagtgcaaccttgtctgaaaggctatcaattgaaanccatacatcagactccatgggactaacaccatcca

SEQ ID NO: 48866 - DNA, 71 bp, chicken (Gallus Gallus)
  misc_feature (36): n=a or t
tgtcctgacagtggagaaggaagtaacagacagtgncataaaatttccaatcagtttataaaacaactatg

SEQ ID NO: 48867 - DNA, 71 bp, chicken (Gallus Gallus)
  misc_feature (36): n=a or t
atactccagcatcaatgtggtctatggatgatagcnctgttcagggctaccattcccttgagtcctgcaca

SEQ ID NO: 48868 - DNA, 71 bp, chicken (Gallus Gallus)
  misc_feature (36): n=a or t
gcaaaagaagctacagaatgtttctttaccagaganatactatgttttcattgataaaaagacaaacatgt

SEQ ID NO: 48869 - DNA, 71 bp, chicken (Gallus Gallus)
  misc_feature (36): n=c or g
ttcccttctctaacttaccttccatgacccacactngttcaaagttgtggcctctcccacatgcagactgc

SEQ ID NO: 48870 - DNA, 71 bp, chicken (Gallus Gallus)
  misc_feature (36): n=c or g
tagaaggtggccacctgggagatgacatgggtttancatcttgctttaatgctgcagccctcgctttgagg

SEQ ID NO: 48871 - DNA, 71 bp, chicken (Gallus Gallus)
  misc_feature (36): n=c or g
gggggagacaatctctgagcctcacaggctgatcanggtgtacttacaagtccacatcaatgtgcatcaca

SEQ ID NO: 48872 - DNA, 71 bp, chicken (Gallus Gallus)
  misc_feature (36): n=c or g
ttgttctgatgctaaacaagaaatttcatagtattntttctaaggccctttctctatttcataagtacact

SEQ ID NO: 48873 - DNA, 71 bp, chicken (Gallus Gallus)
  misc_feature (36): n=c or g
tatacaagcacttgaagagcattacttctcaggctntctgagagatttgcaaggaaaggacagaaggattt

SEQ ID NO: 48874 - DNA, 71 bp, chicken (Gallus Gallus)
  misc_feature (36): n=c or g
tcacctgtgcttgctcggcaggcgcatggctcccanctccacataccagtccttctcccggtaggtcctga

SEQ ID NO: 48875 - DNA, 71 bp, chicken (Gallus Gallus)
  misc_feature (36): n=c or g
aaatacatcacatggcacaggaaactgtaccaacanaactgtagttttactgcttcaattttatcctcagt

SEQ ID NO: 48876 - DNA, 71 bp, chicken (Gallus Gallus)
  misc_feature (36): n=a or t
acaccacaaccctgagtttccagcccagccaactcnaaagtgctttataaaggtgaaatccacgcaaaccg

SEQ ID NO: 48877 - DNA, 71 bp, chicken (Gallus Gallus)
  misc_feature (36): n=a or t
tgcagctcttttacatccattgttttttgaagaggngtgaaatagctaattaactttatgattatgtaaat

SEQ ID NO: 48878 - DNA, 71 bp, chicken (Gallus Gallus)
  misc_feature (36): n=c or g
acagtggattacagagatggaagtgagtgaaagagncccctcacccatctgctctggctctatcccatttt

SEQ ID NO: 48879 - DNA, 71 bp, chicken (Gallus Gallus)
  misc_feature (36): n=c or g
caatgtttgtttctcctgttataagggtactgctgntctatgtctaattcacatactccagatgtcagtgc

SEQ ID NO: 48880 - DNA, 71 bp, chicken (Gallus Gallus)
  misc_feature (36): n=c or g
tctacatcttttcctcttcccgtgtgataaggtaanaaggacacacaatgccaagcactgacagcaggaga

SEQ ID NO: 48881 - DNA, 71 bp, chicken (Gallus Gallus)
  misc_feature (36): n=c or g
taagtctctgtaattatcacttacaataccacactntatgagtattatatcgttcctagtgtttctaccta

SEQ ID NO: 48882 - DNA, 71 bp, chicken (Gallus Gallus)
  misc_feature (36): n=a or t
tagattaacagaattcagttcagaatgcagcagttncatagttgttgctcagttgtgaagcactacactaa

SEQ ID NO: 48883 - DNA, 71 bp, chicken (Gallus Gallus)
  misc_feature (36): n=c or g
tccttgcatctgaaacagccccattcatttcaaatnaatctgatgagatgtgaccagcaaggggcaaagac

SEQ ID NO: 48884 - DNA, 71 bp, chicken (Gallus Gallus)
  misc_feature (36): n=a or t
cagggaagggcagaaatgtgaggctgcttattattntttgaaacaaacattgtgagcaattgaaatgactt

SEQ ID NO: 48885 - DNA, 71 bp, chicken (Gallus Gallus)
  misc_feature (36): n=c or g
cagacattttaatccttcctccatctattttcattntcttgcatatgaatgaggaggcagtctgcttcaca

SEQ ID NO: 48886 - DNA, 71 bp, chicken (Gallus Gallus)
  misc_feature (36): n=a or t
ggctacagccctgagaagttcaccttcgctgattcngtggagcattacatcaaaaccagagcagaggcccg

SEQ ID NO: 48887 - DNA, 71 bp, chicken (Gallus Gallus)
  misc_feature (36): n=a or t
aactccagtctgaacggaactccttaagaccgacgnggtgctaagaagcaggcatttgtcattacggtgcc

SEQ ID NO: 48888 - DNA, 71 bp, chicken (Gallus Gallus)
  misc_feature (36): n=a or t
gaatagcaaactggaacctcctctgggattcattcngccttattctactgccatgggaaactgctctgcag

SEQ ID NO: 48889 - DNA, 71 bp, chicken (Gallus Gallus)
  misc_feature (36): n=c or g
cattctatgatatgagataatcatttcccttatttnagtggttaatcaatcttactgttggacatgaatac

SEQ ID NO: 48890 - DNA, 71 bp, chicken (Gallus Gallus)
  misc_feature (36): n=c or g
gttcctttgtataaccaatgaggaaagctaacttanagaatgcaagctcacagggaagatggaagaatggg

SEQ ID NO: 48891 - DNA, 71 bp, chicken (Gallus Gallus)
  misc_feature (36): n=c or g
tccggtaaccgcaaacgttaacattcctgcgctaancgaaacggagcagacgcagccagcacggtgacaac

SEQ ID NO: 48892 - DNA, 71 bp, chicken (Gallus Gallus)
  misc_feature (36): n=a or t
agctgtatcaacactctattgaaaaacactagaagntgttttaactgtacggacatgggttgaaatcacat

SEQ ID NO: 48893 - DNA, 71 bp, chicken (Gallus Gallus)
  misc_feature (36): n=a or t
tttcactactaattgaacaattagaagtccattcanctgagctcatattgaaaaaagcagtttttcttatc

SEQ ID NO: 48894 - DNA, 71 bp, chicken (Gallus Gallus)
  misc_feature (36): n=a or t
ttaaaagatccaaattccataccaagagactgctcnttgtaacttttaactactatgaaagactgaagtac

SEQ ID NO: 48895 - DNA, 71 bp, chicken (Gallus Gallus)
  misc_feature (36): n=c or g
gatgagagcttttaagatagcacttgaaacttgctnacttaaaattacatatcctacaaacttaagttctt

SEQ ID NO: 48896 - DNA, 71 bp, chicken (Gallus Gallus)
  misc_feature (36): n=a or t
cactgaagaattttacttcagaatcaacgagatgangctagtaaattatagtgccatgataaacagttagg

SEQ ID NO: 48897 - DNA, 71 bp, chicken (Gallus Gallus)
  misc_feature (36): n=a or t
aactaactcagcattgctacaagtgcaaatatctcngtatagtatgggtaaattccatgactctttaccca

SEQ ID NO: 48898 - DNA, 71 bp, chicken (Gallus Gallus)
  misc_feature (36): n=a or t
cttgaaaatactgcttacactcttttcaccaaagangaattctactacaagattccttctactaaagtatg

SEQ ID NO: 48899 - DNA, 71 bp, chicken (Gallus Gallus)
  misc_feature (36): n=c or g
tctccccagttacgtcccttcccctgcccatcaccntttcattttcactgggtacaaccacttcccattct

SEQ ID NO: 48900 - DNA, 71 bp, chicken (Gallus Gallus)
  misc_feature (36): n=a or t
gcagagagttctcactagcatgaagtagccaaaaangaatgggctgtttcttctcacaggtgctcagatgt

SEQ ID NO: 48901 - DNA, 71 bp, chicken (Gallus Gallus)
  misc_feature (36): n=a or t
ccctaggaacaatcgaagaagttcgctgtctttttngtcgatctccacaattgctggtggaactggacaat

SEQ ID NO: 48902 - DNA, 71 bp, chicken (Gallus Gallus)
  misc_feature (36): n=a or t
tctaagatgccatactgaagagtcttcagcatcaanaaacttttcaatttgatctcattgctatgaattgc

SEQ ID NO: 48903 - DNA, 71 bp, chicken (Gallus Gallus)
  misc_feature (36): n=c or g
gttcattcagatgtagcttatattttgggtatgctntgagctaagatgcctttattcatataaatgccact

SEQ ID NO: 48904 - DNA, 71 bp, chicken (Gallus Gallus)
  misc_feature (36): n=a or t
caattcatctgtcaacatttggtatcagtattttgntgacacgtatatccatgaaacttcaatagctccaa

SEQ ID NO: 48905 - DNA, 71 bp, chicken (Gallus Gallus)
  misc_feature (36): n=a or t
ttgctgttaccagagcacaaagacctgaatataaanaggcttctttggtgatggtaatgtttatgggagct

SEQ ID NO: 48906 - DNA, 71 bp, chicken (Gallus Gallus)
  misc_feature (36): n=c or g
ttgttttccaaatttgactcattaaataatatctcncttgagaatgttgtctctgtgaaatgtaatttttc

SEQ ID NO: 48907 - DNA, 71 bp, chicken (Gallus Gallus)
  misc_feature (36): n=a or t
cagaaacctacataaacagcaaaatacctaaacacngtggcatttattaaatacacaagcaggagcagtcc

SEQ ID NO: 48908 - DNA, 71 bp, chicken (Gallus Gallus)
  misc_feature (36): n=c or g
cctctgtcaccccactctactgttgcactgagctgnctgtgctggctttaattgctcttcacctggctgtg

SEQ ID NO: 48909 - DNA, 71 bp, chicken (Gallus Gallus)
  misc_feature (36): n=a or t
gggaggctaaggggagaagcatgcatattttttaangcatttattgtgggagaatggtgctgttcatgtgc

SEQ ID NO: 48910 - DNA, 71 bp, chicken (Gallus Gallus)
  misc_feature (36): n=a or t
tggtcagagacagcttgcagcgatctggtgtggttntctactgctagctgtatgacactgagaatttcata

SEQ ID NO: 48911 - DNA, 71 bp, chicken (Gallus Gallus)
  misc_feature (36): n=a or t
agtattaaattggttcactttgatgcaaaaaacgancaaacaaaaataaaactattgttctcatttctatt

SEQ ID NO: 48912 - DNA, 71 bp, chicken (Gallus Gallus)
  misc_feature (36): n=c or g
caatttcaagagatgaacctgaggcacatcaaaggnaggctctgagtgccaaaatcaactgcagttttacg

SEQ ID NO: 48913 - DNA, 71 bp, chicken (Gallus Gallus)
  misc_feature (36): n=c or g
gctatttctgcttttccatctgaatttatccataantgtgtggatattttctgcttcaaatttaggagcta

SEQ ID NO: 48914 - DNA, 71 bp, chicken (Gallus Gallus)
  misc_feature (36): n=c or g
tgacatcttaaagcattggtatactttctactgtgntaaccaaagggaaacttaactctttagtttgcagt

SEQ ID NO: 48915 - DNA, 71 bp, chicken (Gallus Gallus)
  misc_feature (36): n=a or t
atagcagatctctgagataacagcaataaataatanctggccacagctgagttacacttcaaaaaaagcca

SEQ ID NO: 48916 - DNA, 71 bp, chicken (Gallus Gallus)
  misc_feature (36): n=c or g
caggagctgaaggagaaagtcgcctacctggaggcngaggtgcgtcccagcagggttgttttggggtctgc

SEQ ID NO: 48917 - DNA, 71 bp, chicken (Gallus Gallus)
  misc_feature (36): n=a or t
tgctcctgcagaagttctgttggtgttcggacatgntctgagtctgaaaaaccacctctcacttctgccac

SEQ ID NO: 48918 - DNA, 71 bp, chicken (Gallus Gallus)
  misc_feature (36): n=a or t
tccagaaacactcaagaatgcagcagtagaagaaanatatgtatgtcttaagaagctagggtaagaggacc

SEQ ID NO: 48919 - DNA, 71 bp, chicken (Gallus Gallus)
  misc_feature (36): n=c or g
cacagtgccagcacctcctaggactgtgcatggagntcttgtttacaaccacaaaagccacggcccctccc

SEQ ID NO: 48920 - DNA, 71 bp, chicken (Gallus Gallus)
  misc_feature (36): n=a or t
acttgcacattttcatataggcacatggatcttctnatgtacctgaggacaggcagttgtctctgcacata

SEQ ID NO: 48921 - DNA, 71 bp, chicken (Gallus Gallus)
  misc_feature (36): n=a or t
actaccatcatcactgcatgatttcttcatcagagngctggctagttaatttggtcttttgaagcaaaatt

SEQ ID NO: 48922 - DNA, 71 bp, chicken (Gallus Gallus)
  misc_feature (36): n=c or g
ctctttttctgttttcttagttcccttatctacaantgtaatcgcaccccaggcagtggagaggatgtatt

SEQ ID NO: 48923 - DNA, 71 bp, chicken (Gallus Gallus)
  misc_feature (36): n=a or t
agtgtttctcttttcctgtatcctgagaagtcatanataatctttcatagtgattgttcacctgtgagtaa

SEQ ID NO: 48924 - DNA, 71 bp, chicken (Gallus Gallus)
  misc_feature (36): n=a or t
atcccatacagcatgtcatgaaggggtaccatgatntcagtgatggggagacaaggcggaaaagagatatt

SEQ ID NO: 48925 - DNA, 71 bp, chicken (Gallus Gallus)
  misc_feature (36): n=c or g
ggctgcaatgggtcccagccttcctgcccaggcagnaccttcagctgtggccgcagtgctgtgtttggtgg

SEQ ID NO: 48926 - DNA, 71 bp, chicken (Gallus Gallus)
  misc_feature (36): n=c or g
tctctgagcagccccaaaattctggcattggtaatngctccccctttattttatcatatactcacaataac

SEQ ID NO: 48927 - DNA, 71 bp, chicken (Gallus Gallus)
  misc_feature (36): n=a or t
tagtgaggttactgcctttgaaaatggaatgctacnggaggctgattgataagagctagttggtctgtttg

SEQ ID NO: 48928 - DNA, 71 bp, chicken (Gallus Gallus)
  misc_feature (36): n=a or t
tgcccctcggaaatactgataatttattctacttgnagttcagcagatgttactagagatggacccaacca

SEQ ID NO: 48929 - DNA, 71 bp, chicken (Gallus Gallus)
  misc_feature (36): n=c or g
ggaggactttagtgcatttccatgatactccagaanttcaaaagatagtcttcctactacagattgtagaa

SEQ ID NO: 48930 - DNA, 71 bp, chicken (Gallus Gallus)
  misc_feature (36): n=c or g
tcatagtttatgagtggttaaagggatcaaagacantatatagtgacatcagaaggaagtaatgcaattaa

SEQ ID NO: 48931 - DNA, 71 bp, chicken (Gallus Gallus)
  misc_feature (36): n=a or t
agcacaattcttgaaaccacaacaaggaggtataanataaataggtttatgaataaagggtatagacagaa

SEQ ID NO: 48932 - DNA, 71 bp, chicken (Gallus Gallus)
  misc_feature (36): n=c or g
agatagggtgggaacgggcagttctggcagtacgtnttgctgatggagcaggatgcagtgtgtgctgagca

SEQ ID NO: 48933 - DNA, 71 bp, chicken (Gallus Gallus)
  misc_feature (36): n=c or g
ccaatagggaaaagtagcttagctgtgagaggctgntccatatttcctgttttctaggggagaaaaggagt

SEQ ID NO: 48934 - DNA, 71 bp, chicken (Gallus Gallus)
  misc_feature (36): n=c or g
cacaggggccagagtaacaagaacgagccctgtcantgtgtggatcatagcactggctatagatcccccac

SEQ ID NO: 48935 - DNA, 71 bp, chicken (Gallus Gallus)
  misc_feature (36): n=a or t
ttattatcatcacaacagctaaaggaaggcagtganaagaatttttaaatgggccaggctttgcatgggaa

SEQ ID NO: 48936 - DNA, 71 bp, chicken (Gallus Gallus)
  misc_feature (36): n=a or t
agaatagcctttagaaggatttttaaaagtttctanataaaccatttaaacttatttgtatgaacagctaa

SEQ ID NO: 48937 - DNA, 71 bp, chicken (Gallus Gallus)
  misc_feature (36): n=c or g
cttgtatttacattattagaagatttaatgttcatntagagagctgaaagatgtctggctttaacagtagt

SEQ ID NO: 48938 - DNA, 71 bp, chicken (Gallus Gallus)
  misc_feature (36): n=c or g
cctttctctcttcatgttatcatcttgtactggcanacagaggagatgtctgagtaggagatgcctgatgc

SEQ ID NO: 48939 - DNA, 71 bp, chicken (Gallus Gallus)
  misc_feature (36): n=c or g
tgatttttatatatcaatacctattatagaccttanaaacctggaataaaaaacattgtcataggaggcac

SEQ ID NO: 48940 - DNA, 71 bp, chicken (Gallus Gallus)
  misc_feature (36): n=c or g
ggataaagcagtgctccagcaggatcccatttctgntggatttgcttgctttgccttccaccccaccctgt

SEQ ID NO: 48941 - DNA, 71 bp, chicken (Gallus Gallus)
  misc_feature (36): n=a or t
atcattcttaaatcagataaggaaatattatgagantatattaaagtcatgatgagtcagtgtaagctgag

SEQ ID NO: 48942 - DNA, 71 bp, chicken (Gallus Gallus)
  misc_feature (36): n=c or g
gactgaaatcttgtggcacaagatttgttgtctttntaattgttttgatgaaactgttcatattttgtcaa

SEQ ID NO: 48943 - DNA, 71 bp, chicken (Gallus Gallus)
  misc_feature (36): n=c or g
gttcctggcatgtctaaattcagtgccagatttttnttcttcaaaggcaagaagttaaagaatacaatgac

SEQ ID NO: 48944 - DNA, 71 bp, chicken (Gallus Gallus)
  misc_feature (36): n=c or g
gagggctttctgccatcactccctccccataaccanaggtcatcagtaccagcagtcagggacatcacttg

SEQ ID NO: 48945 - DNA, 71 bp, chicken (Gallus Gallus)
  misc_feature (36): n=a or t
tgtttaagcttaggcccttgcacccagtcgttgtangagttttgttgcagaactgcctctaactgacactg

SEQ ID NO: 48946 - DNA, 71 bp, chicken (Gallus Gallus)
  misc_feature (36): n=c or g
ttgaatactaagcctcatttccacaaggcgagagtncactatttctaaagagccttgctgaagtttttaat

SEQ ID NO: 48947 - DNA, 71 bp, chicken (Gallus Gallus)
  misc_feature (36): n=c or g
aagagcactgagtggcactgggctcttcactctatntggcttcaccctagagctagtctaagtcaaactgt

SEQ ID NO: 48948 - DNA, 71 bp, chicken (Gallus Gallus)
  misc_feature (36): n=c or g
ccatgtggagatgaattgctagaagctgcaggtaancaatgctatagtacaccgttcttcctattaaatat

SEQ ID NO: 48949 - DNA, 71 bp, chicken (Gallus Gallus)
  misc_feature (36): n=c or g
acctctccaaggcagatgccctgaaaatcagaaaangctcaaccattggatttcacaaagtcctagtattg

SEQ ID NO: 48950 - DNA, 71 bp, chicken (Gallus Gallus)
  misc_feature (36): n=c or g
ttcattctaacataatcatttgactacacaatttantaaatatactgcccaagcatagcagtacataacca

SEQ ID NO: 48951 - DNA, 71 bp, chicken (Gallus Gallus)
  misc_feature (36): n=c or g
tgctcaagcttatctgagtaatgcctgagttcagantaagcaatccaaagtcactctgctacaaagcttcc

SEQ ID NO: 48952 - DNA, 71 bp, chicken (Gallus Gallus)
  misc_feature (36): n=c or g
agaatttagcatctattctacagacatttgttcagncaaggaatactactgctgaatacagggctttatac

SEQ ID NO: 48953 - DNA, 71 bp, chicken (Gallus Gallus)
  misc_feature (36): n=a or t
atcatcgagtccaccctccaaatcacctgactcccngctgtaccaaagatatgtgtttgataacagattca

SEQ ID NO: 48954 - DNA, 71 bp, chicken (Gallus Gallus)
  misc_feature (36): n=c or g
aatttggttaatgctttcaactgataaaatgaaaanaaactcagcagtgacatacaacgtctgccatttga

SEQ ID NO: 48955 - DNA, 71 bp, chicken (Gallus Gallus)
  misc_feature (36): n=c or g
agaacaagcctatatttctgtgttgtaaacatcacnctcttcataggccagaggtgtacaaaacataattt

SEQ ID NO: 48956 - DNA, 71 bp, chicken (Gallus Gallus)
  misc_feature (36): n=c or g
cttttctggcacacatttgtccattaaacttgtacnaacagccctctgtaactacaggcagtatcttacag

SEQ ID NO: 48957 - DNA, 71 bp, chicken (Gallus Gallus)
  misc_feature (36): n=c or g
tagtccaaaacaggaagcaaaagaccccgaaatganaatcatgaagcaaagtctgcatggaaccagggagc

SEQ ID NO: 48958 - DNA, 71 bp, chicken (Gallus Gallus)
  misc_feature (36): n=a or t
agaatatgggctggcactttggaattgatagaaatnacaacacctgcaaataatttttgataaaatatcag

SEQ ID NO: 48959 - DNA, 71 bp, chicken (Gallus Gallus)
  misc_feature (36): n=c or g
tgcatgcattggtatggagcatatagatatcttcanatcaacacttgttatcatataattcaaaataaatg

SEQ ID NO: 48960 - DNA, 71 bp, chicken (Gallus Gallus)
  misc_feature (36): n=c or g
ttttcagaaggaagaaagcccaacattgagcaagtnttccttttggcatcaaagcacaaatgccagagaaa

SEQ ID NO: 48961 - DNA, 71 bp, chicken (Gallus Gallus)
  misc_feature (36): n=a or t
agggagaggtaagagtggtaatgtgtggaacaaagnaaagaggcatgacaggaccctgagaaagctcttgc

SEQ ID NO: 48962 - DNA, 71 bp, chicken (Gallus Gallus)
  misc_feature (36): n=c or g
caaagggaatcttttgtagttttagcatagaactantggtcaagagaagaattttgtcctgttaaacaaca

SEQ ID NO: 48963 - DNA, 71 bp, chicken (Gallus Gallus)
  misc_feature (36): n=c or g
aaattctgtaattccctttatcagtaacacgctcantaatgatactagatcaaactataaatgaggtaaat

SEQ ID NO: 48964 - DNA, 71 bp, chicken (Gallus Gallus)
  misc_feature (36): n=a or t
gtggcaagtcttctgtagccaaagatcaggaatcancagtatttctcactttgggatcagcgctggaaaga

SEQ ID NO: 48965 - DNA, 71 bp, chicken (Gallus Gallus)
  misc_feature (36): n=c or g
gcaagtaatttaatacaggacctgcatgccttccanagaaatcctttggctgccctcctttgaaaacccct

SEQ ID NO: 48966 - DNA, 71 bp, chicken (Gallus Gallus)
  misc_feature (36): n=a or t
ctctttatttatgaaagcagtagcactgtcacaacntgttatcatacaagtgccattttgcgtgatttatt

SEQ ID NO: 48967 - DNA, 71 bp, chicken (Gallus Gallus)
  misc_feature (36): n=c or g
tgaaggacggacctcagtagcgccacgttggaattnttgctttcttaacgcagaattggcacatccatatc

SEQ ID NO: 48968 - DNA, 71 bp, chicken (Gallus Gallus)
  misc_feature (36): n=c or g
tgggaatgtggtgcaccaacagctgctgggacgggntatttaacaactcagtttttatccttttcaaaaaa

SEQ ID NO: 48969 - DNA, 71 bp, chicken (Gallus Gallus)
  misc_feature (36): n=a or t
acaacacttcaacgcatttctctgctaagaactggntgtactttgtcattatatagagcagattgcaaatc

SEQ ID NO: 48970 - DNA, 71 bp, chicken (Gallus Gallus)
  misc_feature (36): n=a or t
tgcagttttaataatcagagccagtgtacacacacngtttcaactccactgttaccagttcttgagggaag

SEQ ID NO: 48971 - DNA, 71 bp, chicken (Gallus Gallus)
  misc_feature (36): n=c or g
caagggagcagatgaacaggtacaagttctttcaanactcagttttgtaaattatcctcctattctagctt

SEQ ID NO: 48972 - DNA, 71 bp, chicken (Gallus Gallus)
  misc_feature (36): n=c or g
caagaatttgcctagggcaagaacacgcttaatggntttattattaactgagcaacccaaggatgctcccc

SEQ ID NO: 48973 - DNA, 71 bp, chicken (Gallus Gallus)
  misc_feature (36): n=c or g
tgagctgggtgtcaaattcagcaccacatttggaancaggagcttcacctcaggaaagctgctggagacca

SEQ ID NO: 48974 - DNA, 71 bp, chicken (Gallus Gallus)
  misc_feature (36): n=c or g
cacagagtcatgtcaatcaaagctcctgagctcctnatccatccggagtgggagccccgagtgagacgggt

SEQ ID NO: 48975 - DNA, 71 bp, chicken (Gallus Gallus)
  misc_feature (36): n=a or t
caataactagaatacggtcctcagaagcactcttgnaatacatgatacccttccatacatcctgaataagt

SEQ ID NO: 48976 - DNA, 71 bp, chicken (Gallus Gallus)
  misc_feature (36): n=c or g
ggtggtcagacctcctgagtgttatcgcaagctctntatatattcatgcagtctctttataaaatggaact

SEQ ID NO: 48977 - DNA, 71 bp, chicken (Gallus Gallus)
  misc_feature (36): n=c or g
tgtcaccccggtgtgcgggatcccttctgcacctcnacgctattctccgtctctcacgaatttctgcggtc

SEQ ID NO: 48978 - DNA, 71 bp, chicken (Gallus Gallus)
  misc_feature (36): n=c or g
atttattatgctttatctatatgacagaacctaganagagagcaagacagtcctctcttctataattacaa

SEQ ID NO: 48979 - DNA, 71 bp, chicken (Gallus Gallus)
  misc_feature (36): n=a or t
ctcaatgttagctatataaagagcttccaagctaangccttccaagagacagagttcagtattaacaatag

SEQ ID NO: 48980 - DNA, 71 bp, chicken (Gallus Gallus)
  misc_feature (36): n=c or g
actcaaagcacgccgtgaaggcgagcggcactggtnaactgcagtccccacacactatttattctgcagag

SEQ ID NO: 48981 - DNA, 71 bp, chicken (Gallus Gallus)
  misc_feature (36): n=a or t
tgactgtggaaatgccctccaaaacagagagtgatntcttcctctcgcatggtagatgtctgtctaccttt

SEQ ID NO: 48982 - DNA, 71 bp, chicken (Gallus Gallus)
  misc_feature (36): n=c or g
cacaaactaagcaatactgcagttactgagcagaanctcagaccttccccatcaagaatggaaccttcctg

SEQ ID NO: 48983 - DNA, 71 bp, chicken (Gallus Gallus)
  misc_feature (36): n=a or t
gagacacagggaacgtgactattgttcttcaagaangggacaacattttgcacaccgtacaactgctggat

SEQ ID NO: 48984 - DNA, 71 bp, chicken (Gallus Gallus)
  misc_feature (36): n=c or g
aattcgaggctgtgagaaagaatcttattcttccantggaggagacggacgttggatgaagacgttgccag

SEQ ID NO: 48985 - DNA, 71 bp, chicken (Gallus Gallus)
  misc_feature (36): n=c or g
tcatttatcaccatgccagaggagctaaaggaaaanctgatgccgaagagctgcggcaggatgatcctggt

SEQ ID NO: 48986 - DNA, 71 bp, chicken (Gallus Gallus)
  misc_feature (36): n=a or t
tcccagcattcgctagcacatcatacttggaagttngttcacacatttacaaatattcaaagacataggga

SEQ ID NO: 48987 - DNA, 71 bp, chicken (Gallus Gallus)
  misc_feature (36): n=a or t
ataacagatttcccttgtcccttccttcctaaatcncagagatctcctcacgttaggcagagccataacta

SEQ ID NO: 48988 - DNA, 71 bp, chicken (Gallus Gallus)
  misc_feature (36): n=a or t
cctcctctcatcccaccttcaccatcagctagtttnatctctgacacatcaacccaaattccactgtgtgt

SEQ ID NO: 48989 - DNA, 71 bp, chicken (Gallus Gallus)
  misc_feature (36): n=a or t
gtctaacaaagaaagtaacatttaccctatagctanacttgttaaatgagttcataaaagcatgaatgatg

SEQ ID NO: 48990 - DNA, 71 bp, chicken (Gallus Gallus)
  misc_feature (36): n=c or g
atgctgaatgcttgttttaaatatgtaacacttttnaattctaaagcacagctgaaggttcctggctgtat

SEQ ID NO: 48991 - DNA, 71 bp, chicken (Gallus Gallus)
  misc_feature (36): n=c or g
tggaaaatgaaggctgagcctcagtgctggacaatncatgtggggattcctctggtacctgagatgaagct

SEQ ID NO: 48992 - DNA, 71 bp, chicken (Gallus Gallus)
  misc_feature (36): n=a or t
ataattatattaatgttgttgctcctgaaaatagcntacttctgaaaactactgatgaaaaacagctggga

SEQ ID NO: 48993 - DNA, 71 bp, chicken (Gallus Gallus)
  misc_feature (36): n=c or g
tctcttcctctaagtgacacagcccagtacagtatnttttgctattccagaaaagagagattattagatta

SEQ ID NO: 48994 - DNA, 71 bp, chicken (Gallus Gallus)
  misc_feature (36): n=a or t
ttattcttctttgtgctatgcacacttttccagtgnaggatttgaagatagaagactaagcaaaatacaaa

SEQ ID NO: 48995 - DNA, 71 bp, chicken (Gallus Gallus)
  misc_feature (36): n=a or t
tggcatagtcagttagcacagaagtgtttgaactgntagatgatgtaactctaggacatatactgtgctta

SEQ ID NO: 48996 - DNA, 71 bp, chicken (Gallus Gallus)
  misc_feature (36): n=a or t
catagccggtaacttctaagctaggccaaactatcncttcacagtgtgatgtggtggagagacagttttta

SEQ ID NO: 48997 - DNA, 71 bp, chicken (Gallus Gallus)
  misc_feature (36): n=c or g
attaacagtgtagcagaaagtcaattggaataaatncacttaatatttcagtgaacagtgtctcagtctta

SEQ ID NO: 48998 - DNA, 71 bp, chicken (Gallus Gallus)
  misc_feature (36): n=c or g
acagtaatatatatgacttaaaaaaatatatttctnaagtggggttcaggtctgaaaatctgagatcaaaa

SEQ ID NO: 48999 - DNA, 71 bp, chicken (Gallus Gallus)
  misc_feature (36): n=c or g
  misc_feature (69, 71): n=a
  misc_feature (70): n=c
cgccggcttgctgctcgcggccggcactcgccgggncccgaaacgagggcagcgccgacgcctcgctcnnn

SEQ ID NO: 49000 - DNA, 71 bp, chicken (Gallus Gallus)
  misc_feature (36): n=c or g
agagtcaagctctgtggagtgggacaggaaaatctntttggctgtacaggatgcctggaaggctgaacatc

SEQ ID NO: 49001 - DNA, 71 bp, chicken (Gallus Gallus)
  misc_feature (36): n=c or g
ttctagatgggaaagagcttataatccttttaagantagctttgtgtgatccatttgtttgctgtttgtta

SEQ ID NO: 49002 - DNA, 71 bp, chicken (Gallus Gallus)
  misc_feature (36): n=a or t
atttagctcagcagaggactggcagctcagtatatntgcaccaaaatggcaatacttaaattacacacaaa

SEQ ID NO: 49003 - DNA, 71 bp, chicken (Gallus Gallus)
  misc_feature (36): n=c or g
tcctcagtaacatttgtctgaaattcggctcatctnactgctgaaaagataaatcttgtagcctttttgct

SEQ ID NO: 49004 - DNA, 71 bp, chicken (Gallus Gallus)
  misc_feature (36): n=c or g
ggagagtgtagtccagttctaaaggaaaaagatganactgcagtgtttatttatcctgaactcactcaaaa

SEQ ID NO: 49005 - DNA, 71 bp, chicken (Gallus Gallus)
  misc_feature (36): n=a or t
tgctcccccactgtgggccatgggccccggaaacanacctccagaccagactttccagggtctgctgcact

SEQ ID NO: 49006 - DNA, 71 bp, chicken (Gallus Gallus)
  misc_feature (36): n=a or t
tgtaaaagttgacataactagaagaaacgtttaagnaagaaatcaagataactttcagtagagtctttggg

SEQ ID NO: 49007 - DNA, 71 bp, chicken (Gallus Gallus)
  misc_feature (36): n=a or t
tacttttagggtaaaatcagactttagaatgccctnaatataagtaaattactggtgagactccatcacgt

SEQ ID NO: 49008 - DNA, 71 bp, chicken (Gallus Gallus)
  misc_feature (36): n=c or g
gacaaagatgtggtcttagtcaagcaatcaaacatnaaagagagcccatgtgtataaagtgccttatctgt

SEQ ID NO: 49009 - DNA, 71 bp, chicken (Gallus Gallus)
  misc_feature (36): n=a or t
aaacagtaggatttttttattcttattaaaacttcnaataaaagcctacctgtccagatacaaaagaaggc

SEQ ID NO: 49010 - DNA, 71 bp, chicken (Gallus Gallus)
  misc_feature (36): n=c or g
ggagctgccggtctagatcagctgcctatagcacantaatccatctgcagcacaggaatatcttcatgaga

SEQ ID NO: 49011 - DNA, 71 bp, chicken (Gallus Gallus)
  misc_feature (36): n=c or g
aaagagcattctttggtactcagccttttcagctgnagagaggatgagcatgcccactagtgttctggaaa

SEQ ID NO: 49012 - DNA, 71 bp, chicken (Gallus Gallus)
  misc_feature (36): n=c or g
cagtaagtatcaagagggcaccaaagacctttcatntggggccgaatggtttggccaaatgtttcaggccc

SEQ ID NO: 49013 - DNA, 71 bp, chicken (Gallus Gallus)
  misc_feature (36): n=a or t
cttactatggcatcttaggggaaatattgattttangtgtctttgtgatgtaccagtctactaaaaacagc

SEQ ID NO: 49014 - DNA, 71 bp, chicken (Gallus Gallus)
  misc_feature (36): n=c or g
tcctcaaagcctgacatcttcttgtggccttacagntctggatggccctacagcttctcatggccctacag

SEQ ID NO: 49015 - DNA, 71 bp, chicken (Gallus Gallus)
  misc_feature (36): n=c or g
ttcacatttgtatttatcaacacagcatacacagantctcctagctttggaactgcagactgataaaactt

SEQ ID NO: 49016 - DNA, 71 bp, chicken (Gallus Gallus)
  misc_feature (36): n=a or t
ggttgcacatggctttttgttatgttactggaggcntatgttgtttgtggtatgcctgtctagtcagggct

SEQ ID NO: 49017 - DNA, 71 bp, chicken (Gallus Gallus)
  misc_feature (36): n=c or g
tgctgaattctaactctatcttccaaagacaaatgnatgaaatagagcttcctcttgcagcccggattatt

SEQ ID NO: 49018 - DNA, 71 bp, chicken (Gallus Gallus)
  misc_feature (36): n=a or t
cacagccagcaaccaattgaatttcagcattgaatnttgttctaatgagcagaattcttttctagcctaaa

SEQ ID NO: 49019 - DNA, 71 bp, chicken (Gallus Gallus)
  misc_feature (36): n=c or g
tcgtgtgaactcttcagaagtgccctgaagttgctntaagttgtcatgctaatggaaataccatgcgtggc

SEQ ID NO: 49020 - DNA, 71 bp, chicken (Gallus Gallus)
  misc_feature (36): n=a or t
tatacatagtttaagaagagaaaggtcttttagacngatttttccactgcttatttcttggttgaatctta

SEQ ID NO: 49021 - DNA, 71 bp, chicken (Gallus Gallus)
  misc_feature (36): n=c or g
ggacacatgagaggagaacaacacatctagtacggnacagcttggaggagtggtattgtgtgctccagaga

SEQ ID NO: 49022 - DNA, 71 bp, chicken (Gallus Gallus)
  misc_feature (36): n=c or g
tcattacctattatgactgcaaaagaaatcctgcantctctgcatttaactctttgaacacatcagtggaa

SEQ ID NO: 49023 - DNA, 71 bp, chicken (Gallus Gallus)
  misc_feature (36): n=c or g
cacaatgggatctgtggggcagagagggttctgtanggaagaatgggatctatggggtagagggggttcta

SEQ ID NO: 49024 - DNA, 71 bp, chicken (Gallus Gallus)
  misc_feature (36): n=c or g
catttcctgtatcttcctaatagtcgtacaggtgcntctactagccacctttggatttctaagtcccttga

SEQ ID NO: 49025 - DNA, 71 bp, chicken (Gallus Gallus)
  misc_feature (36): n=a or t
cttctgacatttaacttacaatgaccaattcttgtnttaaaaagtttactcccaccctcattccccacctc

SEQ ID NO: 49026 - DNA, 71 bp, chicken (Gallus Gallus)
  misc_feature (36): n=a or t
acaaagtgctagagaatacaccgtatggggaaaaanttgtgtcagcaaagggatggatgaaatgatctaat

SEQ ID NO: 49027 - DNA, 71 bp, chicken (Gallus Gallus)
  misc_feature (36): n=c or g
tcatttgtgaaataaattagaacaaggaatccaganagataaagtttccttgcatttttataagtagacag

SEQ ID NO: 49028 - DNA, 71 bp, chicken (Gallus Gallus)
  misc_feature (36): n=a or t
cagcactccaggagcctaaaaccgacaggtggttgnatctcggtcctgaacaccggtggcaaatgttatgg

SEQ ID NO: 49029 - DNA, 71 bp, chicken (Gallus Gallus)
  misc_feature (36): n=a or t
tctcatcccctacattacatttctaatcttgaagtnatgcatagattgaattgacattgcaacagaacaat

SEQ ID NO: 49030 - DNA, 71 bp, chicken (Gallus Gallus)
  misc_feature (36): n=c or g
ggacggctggggtggggacagcactacgagcatccntgtgctcatggctgcacccggagaggggcactgct

SEQ ID NO: 49031 - DNA, 71 bp, chicken (Gallus Gallus)
  misc_feature (36): n=a or t
accccaaagacttcactgcttaacattttgtcaagnaagtaaaactgagagttcttttagcttcataatga

SEQ ID NO: 49032 - DNA, 71 bp, chicken (Gallus Gallus)
  misc_feature (36): n=a or t
aaaatgggtagcatccagaaacagcaacctcatgcnctttgcagaccttccaccttaggtttccaatggca

SEQ ID NO: 49033 - DNA, 71 bp, chicken (Gallus Gallus)
  misc_feature (36): n=a or t
cttctttactccaggtgggatgaactgtccctaaanacattaccctccttaacatcttccaccatgtcctg

SEQ ID NO: 49034 - DNA, 71 bp, chicken (Gallus Gallus)
  misc_feature (36): n=c or g
aatggatgagcagttcagttgcttgcttgctacagnggaatgctctccagaactttcaggtgaggatcaaa

SEQ ID NO: 49035 - DNA, 71 bp, chicken (Gallus Gallus)
  misc_feature (36): n=c or g
cataggtaaattagatagaggaaggatgcaaggtantctatgctaaatagagtattggaacttacattaat

SEQ ID NO: 49036 - DNA, 71 bp, chicken (Gallus Gallus)
  misc_feature (36): n=a or t
ttttccatgaaaaggtctcgagaagaaatgttgaanccattgtgttcaatctccaagtttattttcatcat

SEQ ID NO: 49037 - DNA, 71 bp, chicken (Gallus Gallus)
  misc_feature (36): n=c or g
agttctgggagtgccatggggaaaaggggctgacanccctgaagggcaaacagtcccaggggcaaggtgct

SEQ ID NO: 49038 - DNA, 71 bp, chicken (Gallus Gallus)
  misc_feature (36): n=a or t
catgaaatgctctgtataaatgcaaatttatacttntatctagacaggatgaaagcaaatccagaatctgc

SEQ ID NO: 49039 - DNA, 71 bp, chicken (Gallus Gallus)
  misc_feature (36): n=c or g
catcttcatctgatggcacacatggaccatcctttnttcggtgaaccttctgaccttggactatttgtggt

SEQ ID NO: 49040 - DNA, 71 bp, chicken (Gallus Gallus)
  misc_feature (36): n=a or t
gttcatgcatctcttgggtaatgctcttagaaattngtgagtgttgtctgtcatttattctcctaccaatg

SEQ ID NO: 49041 - DNA, 71 bp, chicken (Gallus Gallus)
  misc_feature (36): n=c or g
ttatgcatcactgggtaaactaaagaaacaagctgnataaagctattgggttacttcaggggacctcatag

SEQ ID NO: 49042 - DNA, 71 bp, chicken (Gallus Gallus)
  misc_feature (36): n=c or g
gattctatgttttatttactgtcaacagtagatttntattagatttgtgtctaggtcatgaaatttaagct

SEQ ID NO: 49043 - DNA, 71 bp, chicken (Gallus Gallus)
  misc_feature (36): n=c or g
agaaagacagtacatcgtaagttttatgagccaagntgatgatctgtaaattctggaattgtgtacagttg

SEQ ID NO: 49044 - DNA, 71 bp, chicken (Gallus Gallus)
  misc_feature (36): n=c or g
attatctctaatctttgcaggggaggaactgctagnttgtttttggtattccttagagtaaagagtgttcc

SEQ ID NO: 49045 - DNA, 71 bp, chicken (Gallus Gallus)
  misc_feature (36): n=c or g
ctgttcttctaccgcagctacccagttggtctccantgcacagaggggactcatcccagcatgtcacatga

SEQ ID NO: 49046 - DNA, 71 bp, chicken (Gallus Gallus)
  misc_feature (36): n=c or g
aagcagcatcttacacagagcccattgtaaggatcntgccttaaggctgtgtcctttctttccaagcagaa

SEQ ID NO: 49047 - DNA, 71 bp, chicken (Gallus Gallus)
  misc_feature (36): n=a or t
aacattgctatttagggcacttctgaagtgtcagtngcttgtggtaggagtgaagtatgttgcttcttaca

SEQ ID NO: 49048 - DNA, 71 bp, chicken (Gallus Gallus)
  misc_feature (36): n=a or t
attattgtatggtcatgactgatttcatgatcattnagagatagtacatttaccaaaaacatttggttttg

SEQ ID NO: 49049 - DNA, 71 bp, chicken (Gallus Gallus)
  misc_feature (36): n=c or g
cactttggtataaagctcttcttactggaggtcaanagtccaaaacttacgctgggaataaaaattatcat

SEQ ID NO: 49050 - DNA, 71 bp, chicken (Gallus Gallus)
  misc_feature (36): n=c or g
attccttatatccatctctatgacatggcagagggntacactggtttgaaatttctgcaggatgaaaacat

SEQ ID NO: 49051 - DNA, 71 bp, chicken (Gallus Gallus)
  misc_feature (36): n=c or g
ggaacgtgggctgggcagcatgggacggctgctccntgccaggatctgcttcctccttgttttcctcaccc

SEQ ID NO: 49052 - DNA, 71 bp, chicken (Gallus Gallus)
  misc_feature (36): n=c or g
caatttagtagttgtggtggaaggtggaaagtgagntagaaacatcagtgcatttgggaattagagcatgt

SEQ ID NO: 49053 - DNA, 71 bp, chicken (Gallus Gallus)
  misc_feature (36): n=c or g
ttttgtgtctggagaatagaaaagctctgaatatanagattgtctcagcttaatatttcacttcctctttc

SEQ ID NO: 49054 - DNA, 71 bp, chicken (Gallus Gallus)
  misc_feature (36): n=c or g
tgcttgccatttgtatagacatttttggtcacttanctttagaaattaacatctgtgtaagctgttctcta

SEQ ID NO: 49055 - DNA, 71 bp, chicken (Gallus Gallus)
  misc_feature (36): n=a or t
attgaattgtatcaatcagcgccgaggaatatgtanttttttctttaccgtttattccgtccatagaataa

SEQ ID NO: 49056 - DNA, 71 bp, chicken (Gallus Gallus)
  misc_feature (36): n=c or g
aagtggtggccagcgacagagaatctgtgtggctcnagcactctatcagaacaccaacgttgtcttcttgg

SEQ ID NO: 49057 - DNA, 71 bp, chicken (Gallus Gallus)
  misc_feature (36): n=c or g
gtcaagactctcccagcaagagcactttgtgagaanctgcaatgcagacatttgtgtcatatgcccattag

SEQ ID NO: 49058 - DNA, 71 bp, chicken (Gallus Gallus)
  misc_feature (36): n=c or g
ataaatactgtacggtaaatcaacatgaagcttttntcttagaacaatgaatatcagttcaaaacttcaga

SEQ ID NO: 49059 - DNA, 71 bp, chicken (Gallus Gallus)
  misc_feature (36): n=c or g
aattactctgcacttttatctgagggcatgcctccnacagaaagcatcttaatggagcaataaaaataggc

SEQ ID NO: 49060 - DNA, 71 bp, chicken (Gallus Gallus)
  misc_feature (36): n=c or g
aacttgaagcttatgggtcttttcagtcttctttgnctacaaatgaaacccattttcaaccaaaccaaccc

SEQ ID NO: 49061 - DNA, 71 bp, chicken (Gallus Gallus)
  misc_feature (36): n=a or t
caacaatacactaaaatataataaagttaacattanaattcagcacacggagtgccaacgtgtcccctctc

SEQ ID NO: 49062 - DNA, 71 bp, chicken (Gallus Gallus)
  misc_feature (36): n=a or t
cttctgagagatgattagattgatggatcatgaagnataaaagtgctgtgtggttaccgtaaataaatcat

SEQ ID NO: 49063 - DNA, 71 bp, chicken (Gallus Gallus)
  misc_feature (36): n=a or t
tatccttcgtatgtcagtgtgagcaatgagagcacnttattgtcctgacatggggagatttaatcccttgt

SEQ ID NO: 49064 - DNA, 71 bp, chicken (Gallus Gallus)
  misc_feature (36): n=c or g
acttagcagatttgtggtaggatacaagactcatangtttagaggtgttccatttggcttggttcagtgaa

SEQ ID NO: 49065 - DNA, 71 bp, chicken (Gallus Gallus)
  misc_feature (36): n=c or g
gttttattcactccttataagccccatgactgtggncaaggattaactggcttcagagttcccaagagcaa

SEQ ID NO: 49066 - DNA, 71 bp, chicken (Gallus Gallus)
  misc_feature (36): n=a or t
cttcagtggtgcatgatgagattgctggtgtgcatntcattcactggagaagtacaaatattagcaaaatc

SEQ ID NO: 49067 - DNA, 71 bp, chicken (Gallus Gallus)
  misc_feature (36): n=a or t
tttctacatgccaaagttactcatttaagcctcttnaaagcctgtaaacctaccctgcaaatcttctccaa

SEQ ID NO: 49068 - DNA, 71 bp, chicken (Gallus Gallus)
  misc_feature (36): n=a or t
ggaaaaattatcaatttagatatctaaaagttatanctgaaacagtgtagtggatttgtctcaaagcttag

SEQ ID NO: 49069 - DNA, 71 bp, chicken (Gallus Gallus)
  misc_feature (36): n=c or g
aaaacaattcagcagacaagggtgttgtttagatgntagttgcatcccctcaacaaagcagcaatttagca

SEQ ID NO: 49070 - DNA, 71 bp, chicken (Gallus Gallus)
  misc_feature (36): n=a or t
tgttcaatgttaggtttgctcttggcatcaaatgancaagtggttgatatgttttctttctgggatgtcat

SEQ ID NO: 49071 - DNA, 71 bp, chicken (Gallus Gallus)
  misc_feature (36): n=c or g
aaaagcatttgaagtgtccttgaatgtgagattttngatttggacgacccctctctacagacgttgtctct

SEQ ID NO: 49072 - DNA, 71 bp, chicken (Gallus Gallus)
  misc_feature (36): n=c or g
tggttacaaccactggtcatctcagtcagactatgnaaaaagtaatttctcaagtgacagtaaattaactt

SEQ ID NO: 49073 - DNA, 71 bp, chicken (Gallus Gallus)
  misc_feature (36): n=a or t
ttcagctggagtgtgtccccacacgctgcatctttncatattttttcatcatggcacagtcttaatgaaca

SEQ ID NO: 49074 - DNA, 71 bp, chicken (Gallus Gallus)
  misc_feature (36): n=a or t
agatggaggcaggaagagcaagcctgataggttatnttgtttcaagtaagaaaattgaatatctcagcttg

SEQ ID NO: 49075 - DNA, 71 bp, chicken (Gallus Gallus)
  misc_feature (36): n=c or g
aaggcagaaacacagacatcaatataactttgtaantggagctgcactacatccataggaggaaacagaag

SEQ ID NO: 49076 - DNA, 71 bp, chicken (Gallus Gallus)
  misc_feature (36): n=a or t
ataaagaaaagtgacattggcatcaagggcatgacntttttgtatatcttccaatcctcaagcttaatcaa

SEQ ID NO: 49077 - DNA, 71 bp, chicken (Gallus Gallus)
  misc_feature (36): n=c or g
tgatttgcaatgcacagtataatcttcctaactgcnccaatgccttctgcattcaagcagtacgtggggac

SEQ ID NO: 49078 - DNA, 71 bp, chicken (Gallus Gallus)
  misc_feature (36): n=a or t
taagattcaaaaatcaccattctgacaagaaagcanttactgagagttacagatagggaggtactccctag

SEQ ID NO: 49079 - DNA, 71 bp, chicken (Gallus Gallus)
  misc_feature (36): n=c or g
ttttctacccagctttgacagcacacctgaaagtanagcaaatgaagcaaacacacaaattaaaagtgatg

SEQ ID NO: 49080 - DNA, 71 bp, chicken (Gallus Gallus)
  misc_feature (36): n=a or t
tagatatttctagatcagccacttggaacatagctnatttattatcagttattctaaaggcttataagcta

SEQ ID NO: 49081 - DNA, 71 bp, chicken (Gallus Gallus)
  misc_feature (36): n=c or g
gtaaagagcatcacagggacttgtgtaacatttcantttggggatatgttttaaagaactggtgagcaggg

SEQ ID NO: 49082 - DNA, 71 bp, chicken (Gallus Gallus)
  misc_feature (36): n=a or t
tgtttgggtttggggacaaggactctctctgacttngcacagcgtttcttgcagtgggaccctgacattgg

SEQ ID NO: 49083 - DNA, 71 bp, chicken (Gallus Gallus)
  misc_feature (36): n=a or t
aaaatgtaagtgaggttgagagttcaatgtatgatntaaattatttcaaggtatccttttagcttggaaga

SEQ ID NO: 49084 - DNA, 71 bp, chicken (Gallus Gallus)
  misc_feature (36): n=c or g
acaccattataaatggtattctaggactaacctccnaagtgcaacttgcgtgtgaaaataagagctcaggg

SEQ ID NO: 49085 - DNA, 71 bp, chicken (Gallus Gallus)
  misc_feature (36): n=a or t
ataatacataataaaaccacagattaggccattgtntaagtagaaatcctatgtatgtttgtggatccctt

SEQ ID NO: 49086 - DNA, 71 bp, chicken (Gallus Gallus)
  misc_feature (36): n=c or g
cagtggcaatggggagagcacaatgccaacagagancaatgctgccctacagagtgcagaattcagatgga

SEQ ID NO: 49087 - DNA, 71 bp, chicken (Gallus Gallus)
  misc_feature (36): n=c or g
gggatttggcacatgcaatatgattttaggaagctntcccttgcagcttttcagatactccgtgtaaatgt

SEQ ID NO: 49088 - DNA, 71 bp, chicken (Gallus Gallus)
  misc_feature (36): n=c or g
agggcaatttctctgccagacactctctgaatacancatatgcaaagtcattgattttctttagacccagt

SEQ ID NO: 49089 - DNA, 71 bp, chicken (Gallus Gallus)
  misc_feature (36): n=c or g
ttgtagtagaaaacctaaaagagggagtttacctgntacttgttgcaactaaggggcagaatatgggtggg

SEQ ID NO: 49090 - DNA, 71 bp, chicken (Gallus Gallus)
  misc_feature (36): n=a or t
attaagatggaactaagccacaatccccactgagcncactgatgccaaattcagtcattttcaaaaacaga

SEQ ID NO: 49091 - DNA, 71 bp, chicken (Gallus Gallus)
  misc_feature (36): n=c or g
gagctcgctttccctcaggctaaatttttcacgacnattttgcaaggcgcgtatatgcatataaataaagc

SEQ ID NO: 49092 - DNA, 71 bp, chicken (Gallus Gallus)
  misc_feature (36): n=a or t
ttggtgacagacagaattacgttaatgattcttacnatgtcagaattcatggtctcattttaaaacgtaga

SEQ ID NO: 49093 - DNA, 71 bp, chicken (Gallus Gallus)
  misc_feature (36): n=a or t
cttctgcatggaggagctaagataatatttgcaatntagtcatgtaattggcagcttcagactgtgcatct

SEQ ID NO: 49094 - DNA, 71 bp, chicken (Gallus Gallus)
  misc_feature (36): n=c or g
aaaggacaaaaaccatacaatgaattggtcataagngaaacataaaacattcagattcctatgcgcttcca

SEQ ID NO: 49095 - DNA, 71 bp, chicken (Gallus Gallus)
  misc_feature (36): n=c or g
ttgactacctattggcaattttacttcaactgcacnctatagataatttagtatattgctaaataaagttc

SEQ ID NO: 49096 - DNA, 71 bp, chicken (Gallus Gallus)
  misc_feature (36): n=a or t
gaacatgggagtactaccctgctctgcatgtctgcntgtagagctctgtcatttctcaagccacactgggg

SEQ ID NO: 49097 - DNA, 71 bp, chicken (Gallus Gallus)
  misc_feature (36): n=a or t
acctcagtaaagaattttatttttttctcttcattntgtttttctaacatcttggcatacagttatttatt

SEQ ID NO: 49098 - DNA, 71 bp, chicken (Gallus Gallus)
  misc_feature (36): n=a or t
ctcatcagtgtattacttaatccttgagttttcccncaatgagtggactattgcatcacaacacatcagtg

SEQ ID NO: 49099 - DNA, 71 bp, chicken (Gallus Gallus)
  misc_feature (36): n=a or t
tcaacaaaaagggaagtggaagagaagtggtccccnctaatccatagcctttcagccacagtacttctaca

SEQ ID NO: 49100 - DNA, 71 bp, chicken (Gallus Gallus)
  misc_feature (36): n=c or g
aagggaattttaccatttgctcttgctgatggctgnaagtcatgtcacagagtggttccaggctcagatcc

SEQ ID NO: 49101 - DNA, 71 bp, chicken (Gallus Gallus)
  misc_feature (36): n=c or g
aatttcattaaatgaaacataccctaaacctaaaanctcattaataggaacttaccattaatctgatttta

SEQ ID NO: 49102 - DNA, 71 bp, chicken (Gallus Gallus)
  misc_feature (36): n=a or t
aaattcaatgactcccagctcttggcccttcccaanatcattttaaatgctcaattgtccaaccatgtata

SEQ ID NO: 49103 - DNA, 71 bp, chicken (Gallus Gallus)
  misc_feature (36): n=a or t
ctgagctttccccaggatcagtgctctctatccaantctctttgggaactgaatatattgactaccatcct

SEQ ID NO: 49104 - DNA, 71 bp, chicken (Gallus Gallus)
  misc_feature (36): n=a or t
tgcccaggtaagaaggcatgctcgtgtcccgtattnacaggcaggtcttcttttttgttagtgcagaaaag

SEQ ID NO: 49105 - DNA, 71 bp, chicken (Gallus Gallus)
  misc_feature (36): n=c or g
atgctccttgcatgcacaccgctgcaacgctgtcanatcatgtttgcatccaggaaagcactgctgcaaag

SEQ ID NO: 49106 - DNA, 71 bp, chicken (Gallus Gallus)
  misc_feature (36): n=c or g
ttctatggtaaaacgtacatgatgtttgcattttantgatatgtattcagctggatctgtgtcacagaggt

SEQ ID NO: 49107 - DNA, 71 bp, chicken (Gallus Gallus)
  misc_feature (36): n=c or g
caagtcacaaaagcctgtctcatagcaagataatgntccatttattaatctattctaaaaaggtattttaa

SEQ ID NO: 49108 - DNA, 71 bp, chicken (Gallus Gallus)
  misc_feature (36): n=c or g
ctcaggtggatttatgaagagccacttgtttagtanagatgctatacaatcagtttcagtgcatcgtaatg

SEQ ID NO: 49109 - DNA, 71 bp, chicken (Gallus Gallus)
  misc_feature (36): n=a or t
ctgtactggcttgtcctttccctgctagatttttcnttgctgtaactctggtccctaaaaaactatctgta

SEQ ID NO: 49110 - DNA, 71 bp, chicken (Gallus Gallus)
  misc_feature (36): n=a or t
aagtatggagaattcaaagacagaccatatttgccnttatgagtccttgaaggcttttctgttctcaccca

SEQ ID NO: 49111 - DNA, 71 bp, chicken (Gallus Gallus)
  misc_feature (36): n=c or g
accagggaggtcttgccctccagttcccacattcanatggctgcttccccctgacttctgtggcactctgc

SEQ ID NO: 49112 - DNA, 71 bp, chicken (Gallus Gallus)
  misc_feature (36): n=a or t
tgtactctccaacactttttatgtacagttgaacanatggccttaaaaatacaggtttgttaaagtatttc

SEQ ID NO: 49113 - DNA, 71 bp, chicken (Gallus Gallus)
  misc_feature (36): n=c or g
atgctgcagaagcattttttggaagtattgacagtnagtctttggtaagaagagagctcatacgtagcacg

SEQ ID NO: 49114 - DNA, 71 bp, chicken (Gallus Gallus)
  misc_feature (36): n=a or t
atactgttcttttttaaacattcaattttttctacnctggtaatctttctcctacataaattttccagtgt

SEQ ID NO: 49115 - DNA, 71 bp, chicken (Gallus Gallus)
  misc_feature (36): n=c or g
catatgagataagagatgtttcactgaaatgacttnctgggaagatggtattgactctcctattaggtagg

SEQ ID NO: 49116 - DNA, 71 bp, chicken (Gallus Gallus)
  misc_feature (36): n=a or t
gtaagccaccagtagctggagtactcaggaaacatnaatgcttgtccttacagtcctgcctaggcatcctg

SEQ ID NO: 49117 - DNA, 71 bp, chicken (Gallus Gallus)
  misc_feature (36): n=a or t
gcaaacaacaatttcccctgccacatgcattccacngaaagatcctggccgtgtctcagataaagaagctg

SEQ ID NO: 49118 - DNA, 71 bp, chicken (Gallus Gallus)
  misc_feature (36): n=a or t
ggggtgtatttcatgaccagtggctccttgcaaagngggggcagtttgggaaggagggcagaggggttttg

SEQ ID NO: 49119 - DNA, 71 bp, chicken (Gallus Gallus)
  misc_feature (36): n=c or g
taagattgcttcctggagattgcattcttgcagcancacagatatttctaccatcaaaagcaaattctgga

SEQ ID NO: 49120 - DNA, 71 bp, chicken (Gallus Gallus)
  misc_feature (36): n=c or g
cctttccaaatcttgatgataaactctgcttgatcngtaagaattaccatcagtgttttgaaatcacctga

SEQ ID NO: 49121 - DNA, 71 bp, chicken (Gallus Gallus)
  misc_feature (36): n=a or t
ttcactgccccaggatcgttaattacactgtttagnacattctgccttttaggcaatttcaagcattgtat

SEQ ID NO: 49122 - DNA, 71 bp, chicken (Gallus Gallus)
  misc_feature (36): n=c or g
gatatatctacaacagcaacatcaaatgattcctanaggtcaccacagatggctgcacagggtcacaaatt

SEQ ID NO: 49123 - DNA, 71 bp, chicken (Gallus Gallus)
  misc_feature (36): n=c or g
ctgcaaatgtggacagggatgttatccatgctgagnccactgctgtccctaggtcggaaggatgtcaccct

SEQ ID NO: 49124 - DNA, 71 bp, chicken (Gallus Gallus)
  misc_feature (36): n=a or t
aagaaagcagcagattgcctttgaagagaggaaccngtattccccattggctgagagcttgctgtgatagc

SEQ ID NO: 49125 - DNA, 71 bp, chicken (Gallus Gallus)
  misc_feature (36): n=c or g
ctccgtgtgaactcttactacgtgtcacccccatangagcaaagagtgcagctttctaattctacagagat

SEQ ID NO: 49126 - DNA, 71 bp, chicken (Gallus Gallus)
  misc_feature (36): n=c or g
cagtgatgggaaatccctttctccatgaaagaattntcagagccttgtatcctaaaatgtacagcttgaga

SEQ ID NO: 49127 - DNA, 71 bp, chicken (Gallus Gallus)
  misc_feature (36): n=c or g
gtactgcacagcaggaacgtggttcttgcagagcantgtctgtaaggaaaagcaactaaaatctatagcaa

SEQ ID NO: 49128 - DNA, 71 bp, chicken (Gallus Gallus)
  misc_feature (36): n=a or t
tttgcataacagaacgtggatgggatttaggaagantacagatgtttgcagagatcgcaggagggcatgag

SEQ ID NO: 49129 - DNA, 71 bp, chicken (Gallus Gallus)
  misc_feature (36): n=a or t
tctaccttgtgtagacgtctgacagagcaatgctgntatcaccttgccctgattttctgccatggttatgc

SEQ ID NO: 49130 - DNA, 71 bp, chicken (Gallus Gallus)
  misc_feature (36): n=c or g
ctgggatgataaatatactaaagaaatttatattanggaagacatgaaaaggtagttacagttttaaagct

SEQ ID NO: 49131 - DNA, 71 bp, chicken (Gallus Gallus)
  misc_feature (36): n=c or g
tccttccactttcagctttcaaaccactgctgtcgnagacaaaactgccaacgtcctctttgaaacttagt

SEQ ID NO: 49132 - DNA, 71 bp, chicken (Gallus Gallus)
  misc_feature (36): n=c or g
ccgtaccttaaagtaagtgcaaaataatagaactgnctaatgatccagcttggaggattttttgcgaggaa

SEQ ID NO: 49133 - DNA, 71 bp, chicken (Gallus Gallus)
  misc_feature (36): n=c or g
aaaaattattcctgtttacttcatgatgaggaatanaagcacttctccagcttaaagaaaaagccacgaaa

SEQ ID NO: 49134 - DNA, 71 bp, chicken (Gallus Gallus)
  misc_feature (36): n=c or g
tgtagtgttttgttctggtggtttttacttgtgggnttttcttgacccatccattgtcctttaattcttct

SEQ ID NO: 49135 - DNA, 71 bp, chicken (Gallus Gallus)
  misc_feature (36): n=c or g
aagaatcagtacttgacaaaacagtcaaggtctttncattacgtttgatctactgcacaatgagtccattt

SEQ ID NO: 49136 - DNA, 71 bp, chicken (Gallus Gallus)
  misc_feature (36): n=c or g
ttgccatgtcatcgtcacaggtgaatggctggctgntgctgccttgtgtgcacctgcagcagaaagcaata

SEQ ID NO: 49137 - DNA, 71 bp, chicken (Gallus Gallus)
  misc_feature (36): n=c or g
gaacaaaaggtgaccagaaacactttgctaagttgnagctaatatcagtgggtaccaattgttctctctct

SEQ ID NO: 49138 - DNA, 71 bp, chicken (Gallus Gallus)
  misc_feature (36): n=c or g
gagcagcagctgctctgcccaacccgctgcaaggangcagtgactgtcagccctcgtgtcccacaccggga

SEQ ID NO: 49139 - DNA, 71 bp, chicken (Gallus Gallus)
  misc_feature (36): n=a or t
ctgaaaattcatatggcttattttacaggtagtgtncacaatgtgcttgcccaagagaagtttaccaacat

SEQ ID NO: 49140 - DNA, 71 bp, chicken (Gallus Gallus)
  misc_feature (36): n=c or g
gggagagataagaagctaactactcctgaagtcctncctgctaactaactaggacctctgaaggggcatat

SEQ ID NO: 49141 - DNA, 71 bp, chicken (Gallus Gallus)
  misc_feature (36): n=c or g
actttagatatatcgcttccatttaataattcaaanaaaatgtgccaaatagtgatattgtaaagtctgcc

SEQ ID NO: 49142 - DNA, 71 bp, chicken (Gallus Gallus)
  misc_feature (36): n=c or g
ggcacaggggaacactgagaaatgtggtcctaaaancaaaacagcaagcagtgccatctccagcccggcgt

SEQ ID NO: 49143 - DNA, 71 bp, chicken (Gallus Gallus)
  misc_feature (36): n=c or g
taatcaatacatacggactatctaaagaacagttantagtaattatatcaccaatcctgtagctcacaaaa

SEQ ID NO: 49144 - DNA, 71 bp, chicken (Gallus Gallus)
  misc_feature (36): n=c or g
agacagcatctcccagaaatctgctgccacacggtnggtgttttacagcagatgaaacagtttgaaactgt

SEQ ID NO: 49145 - DNA, 71 bp, chicken (Gallus Gallus)
  misc_feature (36): n=a or t
tatacccccttatttatagcttgaggaacaaggaantcagaggagtcctaaggaaaatgttgaggaggaag

SEQ ID NO: 49146 - DNA, 71 bp, chicken (Gallus Gallus)
  misc_feature (36): n=c or g
atccaaaaaggccacggtgcatttactgttttgganagtcacaattactgcactcatctgtgagcatctca

SEQ ID NO: 49147 - DNA, 71 bp, chicken (Gallus Gallus)
  misc_feature (36): n=c or g
agtcagtcagcttttagagtctcagtgaaaccatgntcccagtcaccaaatgcatgtctgtctctccaaac

SEQ ID NO: 49148 - DNA, 71 bp, chicken (Gallus Gallus)
  misc_feature (36): n=c or g
tgggcttcaactggtctgagaagggaaagtgacatnttcaggaggagtctgacgccatcctgacctctgaa

SEQ ID NO: 49149 - DNA, 71 bp, chicken (Gallus Gallus)
  misc_feature (36): n=a or t
attctacttacaccatctacacccagatatcagacngaaccttaggtttgatcagtctttgaccactaaat

SEQ ID NO: 49150 - DNA, 71 bp, chicken (Gallus Gallus)
  misc_feature (36): n=a or t
tttggacacagtgagtccatacagttatctcagatnggtagtttctctattttgcatttcgtcacgtttcc

SEQ ID NO: 49151 - DNA, 71 bp, chicken (Gallus Gallus)
  misc_feature (36): n=c or g
catagtgatgcaagtgcagtgttggaaaaatctagntattataaaagatattaaagaactaatcacaagta

SEQ ID NO: 49152 - DNA, 71 bp, chicken (Gallus Gallus)
  misc_feature (36): n=a or t
tctgtttgtgccttactgaattcaaacaaacccccnaatgtctcctttcttatgcatataactgctgtggg

SEQ ID NO: 49153 - DNA, 71 bp, chicken (Gallus Gallus)
  misc_feature (36): n=c or g
cgccccaacagggtgagctgagtgtaccttccagtntgctcttgcacaacaccagcagttatgaagagcct

SEQ ID NO: 49154 - DNA, 71 bp, chicken (Gallus Gallus)
  misc_feature (36): n=a or t
tacaacaccccatgttatttactggtttccaaaacntaccaccaaaatgctaccttgatgatgccaaggtg

SEQ ID NO: 49155 - DNA, 71 bp, chicken (Gallus Gallus)
  misc_feature (36): n=a or t
aaatgtacatcatctgcctgtcttcttttgttcttntgtctgagccttacacagaatggaaccttccttaa

SEQ ID NO: 49156 - DNA, 71 bp, chicken (Gallus Gallus)
  misc_feature (36): n=a or t
agagaactgaccctgtcgaggtgggaatttgtccantttgcacaactgaggctgagctctgggagtaggga

SEQ ID NO: 49157 - DNA, 71 bp, chicken (Gallus Gallus)
  misc_feature (36): n=c or g
actaatccagcagcccacctttctaatgatcatcantggcatttgattcctgaaaggacccatgcttctgc

SEQ ID NO: 49158 - DNA, 71 bp, chicken (Gallus Gallus)
  misc_feature (36): n=a or t
tatttccaaaccttctggtagagacataaaacagtnagcccttatttcaccctgtaacacagtccctaatc

SEQ ID NO: 49159 - DNA, 71 bp, chicken (Gallus Gallus)
  misc_feature (36): n=c or g
catgtttcttcatcattccaggatggtcacatcctntaagacacatacaggaatcaaaactgtccttttca

SEQ ID NO: 49160 - DNA, 71 bp, chicken (Gallus Gallus)
  misc_feature (36): n=c or g
attcaaataaggattaaaaaggatcctgtggtaaantaaatgcacgtgaaggttatataatgtctgcaaga

SEQ ID NO: 49161 - DNA, 71 bp, chicken (Gallus Gallus)
  misc_feature (36): n=a or t
tctaataatagttctcctccatccctttatttttanaagtatctgagtaaaaatggaatcaccttactcaa

SEQ ID NO: 49162 - DNA, 71 bp, chicken (Gallus Gallus)
  misc_feature (36): n=c or g
tatcacttctctctaaaataacctctttgctgacantgcttcaagcagagagagatcttccaacgagtgct

SEQ ID NO: 49163 - DNA, 71 bp, chicken (Gallus Gallus)
  misc_feature (36): n=c or g
gtctgtatctcagggaagtgagagaaacaggtatgnttggataagaatgtccaaaacgttgttatccagaa

SEQ ID NO: 49164 - DNA, 71 bp, chicken (Gallus Gallus)
  misc_feature (36): n=c or g
aatcacttgaaggtaatcatgtaacacagcagaaanaaactattatctctgtattttatctactgcttact

SEQ ID NO: 49165 - DNA, 71 bp, chicken (Gallus Gallus)
  misc_feature (36): n=a or t
gtgaccatcacctctacagtgaccatacaagtgccntcagctgagataaatgccatttgtgtgtgtgtgtg

SEQ ID NO: 49166 - DNA, 71 bp, chicken (Gallus Gallus)
  misc_feature (36): n=a or t
tctcaactagaaggtcttatattcatgcagataggnagagctatactgcctacttatgatgagacgcataa

SEQ ID NO: 49167 - DNA, 71 bp, chicken (Gallus Gallus)
  misc_feature (36): n=c or g
aatgacttgcaggactgcaagggcgcagtggcactngtgttatactttccaacagcatttcagctctgcga

SEQ ID NO: 49168 - DNA, 71 bp, chicken (Gallus Gallus)
  misc_feature (36): n=c or g
ctatgacttctgcccccgaatcttcccagcagtccncatgtcccaggctctgagcacaatctgatggctcc

SEQ ID NO: 49169 - DNA, 71 bp, chicken (Gallus Gallus)
  misc_feature (36): n=a or t
tgtcttggatgtgtgtggagaactgctccatggtcncttttacaaaagcaaaaaggccaaatcgagtggaa

SEQ ID NO: 49170 - DNA, 71 bp, chicken (Gallus Gallus)
  misc_feature (36): n=a or t
ttatggagttcatactcagaagcttttagacaaaangcagtatgttattttacagaagagtaggtctcagg

SEQ ID NO: 49171 - DNA, 71 bp, chicken (Gallus Gallus)
  misc_feature (36): n=a or t
ttctaaattacagggtgatacctgagagaaaggctntactttaagacttttatattgtaatgttctttcta

SEQ ID NO: 49172 - DNA, 71 bp, chicken (Gallus Gallus)
  misc_feature (36): n=a or t
ggttgagatggagtttgtacttctttaagatggaangaggagttgctatgtttctatgcagctaaatgagc

SEQ ID NO: 49173 - DNA, 71 bp, chicken (Gallus Gallus)
  misc_feature (36): n=c or g
aatcctactcaaataatgcacccgtcaaaactgaantgattatttctataaagtatgttgatcttcctgta

SEQ ID NO: 49174 - DNA, 71 bp, chicken (Gallus Gallus)
  misc_feature (36): n=c or g
ttacaactgaaacactttcatatggccaaactgaantggtgtatttaacatccagaccacatgtctttgat

SEQ ID NO: 49175 - DNA, 71 bp, chicken (Gallus Gallus)
  misc_feature (36): n=a or t
caccatgaactagcttacagatttctagaattttcngatgttcatccttattcaccaacaggcaattttga

SEQ ID NO: 49176 - DNA, 71 bp, chicken (Gallus Gallus)
  misc_feature (36): n=a or t
ccaatgacctcctcaattttgatgaaggacacatcnatctctttggcaaactctcgaatagcttcattggg

SEQ ID NO: 49177 - DNA, 71 bp, chicken (Gallus Gallus)
  misc_feature (36): n=a or t
tacattataaacttgatgcattattcaggccttaangtatttccatatagtgccaagtaactgtaattccg

SEQ ID NO: 49178 - DNA, 71 bp, chicken (Gallus Gallus)
  misc_feature (36): n=a or t
aaccaggagccgtgttgaaggagaagtttgttttgngtgatctgctttatataagggtgcttggcaattca

SEQ ID NO: 49179 - DNA, 71 bp, chicken (Gallus Gallus)
  misc_feature (36): n=a or t
acttatcaaaagatggccacttctggtaaatgctanggagtaagtcaatttagttgtcatattattcccta

SEQ ID NO: 49180 - DNA, 71 bp, chicken (Gallus Gallus)
  misc_feature (36): n=a or t
atccgggtaggtagtggaagacttttctttttaaantgtcaagtactttcacactaataatttagcctcaa

SEQ ID NO: 49181 - DNA, 71 bp, chicken (Gallus Gallus)
  misc_feature (36): n=a or t
aaggcaacaaatgaatattcaattcctgtcaccacnaagtttctacgtttcaaagagaactcaaactattt

SEQ ID NO: 49182 - DNA, 71 bp, chicken (Gallus Gallus)
  misc_feature (36): n=c or g
catgtgtcctgcttccagaaacatcacaatgaaganttgagtgaaacttttctccagaataagtaattcca

SEQ ID NO: 49183 - DNA, 71 bp, chicken (Gallus Gallus)
  misc_feature (36): n=c or g
tctgaaagccacacttaaaaaactgcaccaccattnttacactgtgtatgacttcattttaataaaggaat

SEQ ID NO: 49184 - DNA, 71 bp, chicken (Gallus Gallus)
  misc_feature (36): n=c or g
tcactttttttccagaaagttggacatcaaaagtantggagatgcataaacatgagaaatataaagaaata

SEQ ID NO: 49185 - DNA, 71 bp, chicken (Gallus Gallus)
  misc_feature (36): n=c or g
gctcagggtagttctcagataggttttcatttacanaagcaggtaggacagagcttaaagagttctccaga

SEQ ID NO: 49186 - DNA, 71 bp, chicken (Gallus Gallus)
  misc_feature (36): n=c or g
cagagaagtcattgccccttttgccaccacgtacanccacgcagccttctgaatatggccatcccttggct

SEQ ID NO: 49187 - DNA, 71 bp, chicken (Gallus Gallus)
  misc_feature (36): n=c or g
acaaaaccagtaatgcacaactgtagtcatttacanatgaggctaacctgctcagcatgttatcaaaatat

SEQ ID NO: 49188 - DNA, 71 bp, chicken (Gallus Gallus)
  misc_feature (36): n=c or g
caaccctactactcttgtatgggtgaaggctgcatntctactgcgaggcttcttggggagctgttcagctt

SEQ ID NO: 49189 - DNA, 71 bp, chicken (Gallus Gallus)
  misc_feature (36): n=a or t
aattaactgaaggttaatatttaaaagcttctcttnaaaatacagtgtagggagttttgatctatattggg

SEQ ID NO: 49190 - DNA, 71 bp, chicken (Gallus Gallus)
  misc_feature (36): n=a or t
agatatcttgatattgaactgtatttagaaaacaancgtacatcagaaacactattgagcaaaaataattt

SEQ ID NO: 49191 - DNA, 71 bp, chicken (Gallus Gallus)
  misc_feature (36): n=a or t
tttgctgtagagtactaagctaaagcctgcatggangctgacgcaggaaggtgtttctcctgccccaagct

SEQ ID NO: 49192 - DNA, 71 bp, chicken (Gallus Gallus)
  misc_feature (36): n=a or t
cttcactcactaagctaattgtacaggtagagaacncctgcagtttctggcatctgttaatcattagacct

SEQ ID NO: 49193 - DNA, 71 bp, chicken (Gallus Gallus)
  misc_feature (36): n=a or t
ggtatacagtgtctgagatcactcttagcaggctgnttgcttttgtgtcagctaaacgcattatttctggt

SEQ ID NO: 49194 - DNA, 71 bp, chicken (Gallus Gallus)
  misc_feature (36): n=a or t
tagaatgcattagggtgtttcatgcaaaatgccttngttccataacttttatgcattcaggcgaaaacacg

SEQ ID NO: 49195 - DNA, 71 bp, chicken (Gallus Gallus)
  misc_feature (36): n=a or t
cactaacttcactaattgccatggggccatcaaganttttaattgttagcatgcacttaaagtctgtctta

SEQ ID NO: 49196 - DNA, 71 bp, chicken (Gallus Gallus)
  misc_feature (36): n=c or g
acagagcagttaagctaatctgagttgtgttcagantaagttaactcctacactcaggaatggtgttgaaa

SEQ ID NO: 49197 - DNA, 71 bp, chicken (Gallus Gallus)
  misc_feature (36): n=a or t
tgcctaagtcctttaagaaggaaaggttttctaatngatacacagaaggctaatttgcagaggtgagttgg

SEQ ID NO: 49198 - DNA, 71 bp, chicken (Gallus Gallus)
  misc_feature (36): n=c or g
actgtaggtacacatccatctgtcccgtgagggctncccatcctcctctaacggcactggtcgtgtctgtc

SEQ ID NO: 49199 - DNA, 71 bp, chicken (Gallus Gallus)
  misc_feature (36): n=c or g
ggctccttgatagcctgtgaattcctgctgcagaanggggcagacgttaaccaaaaagatagcagaggccg

SEQ ID NO: 49200 - DNA, 71 bp, chicken (Gallus Gallus)
  misc_feature (36): n=a or t
gagaggaaaactaaatcatgccaagatcttgctaanaaagtctttctacctcttaaaataaagacatgtac

SEQ ID NO: 49201 - DNA, 71 bp, chicken (Gallus Gallus)
  misc_feature (36): n=c or g
agaagccaggctgcgttatgcacaaagcttgtaaantgttggcattatgagtggcacctagaaaaagctgg

SEQ ID NO: 49202 - DNA, 71 bp, chicken (Gallus Gallus)
  misc_feature (36): n=a or t
ggagtgccaggcaagcactaagtgttccactccatnttgcaatcatgctgtcacaccaagagcactgtttt

SEQ ID NO: 49203 - DNA, 71 bp, chicken (Gallus Gallus)
  misc_feature (36): n=a or t
tatgaaatgttttataacctgttggaagactaaacntatttactgaaaagctcttatgacagtattttgtg

SEQ ID NO: 49204 - DNA, 71 bp, chicken (Gallus Gallus)
  misc_feature (36): n=a or t
aaactccagcaaatatacagaaagatctcatccttntcaagaggcacaggagtgaattgatgagcggcccg

SEQ ID NO: 49205 - DNA, 71 bp, chicken (Gallus Gallus)
  misc_feature (36): n=a or t
taatcctaaagtcagtattaaaagaattgctctgtngaggtgcttttagaggtaaaggttgattgaatctc

SEQ ID NO: 49206 - DNA, 71 bp, chicken (Gallus Gallus)
  misc_feature (36): n=a or t
acagggtccttctaaaagagatgtttaggctatttntatcaagatagttcttggagcatcaaacttctcca

SEQ ID NO: 49207 - DNA, 71 bp, chicken (Gallus Gallus)
  misc_feature (36): n=a or t
tactttgctgactttgttactttatataaatgtttnaagacaattcaataaagtgcaatttctttgagaca

SEQ ID NO: 49208 - DNA, 71 bp, chicken (Gallus Gallus)
  misc_feature (36): n=c or g
ctggccttgagtcatcacccacctgctggccatcantcatccctttcaatcttaccttactaccctttttc

SEQ ID NO: 49209 - DNA, 71 bp, chicken (Gallus Gallus)
  misc_feature (36): n=c or g
tgcagccactcctttcagcttctaaatggacttctnagccacagtgttttcactgcttcactgtagcattt

SEQ ID NO: 49210 - DNA, 71 bp, chicken (Gallus Gallus)
  misc_feature (36): n=c or g
cgcctgtttctgaggcaatgccagtaagtcgctganatttccagcccgaggagcacagaatctgattagaa

SEQ ID NO: 49211 - DNA, 71 bp, chicken (Gallus Gallus)
  misc_feature (36): n=c or g
aggacctgaggagtattgttcaaattctatactagnagccctttctaaggaaaagcagtgagttaaaagca

SEQ ID NO: 49212 - DNA, 71 bp, chicken (Gallus Gallus)
  misc_feature (36): n=c or g
tacatgttttagcatctctgttgaatgccagtgttnattatcagttatgttagccatgagctgtaagtcat

SEQ ID NO: 49213 - DNA, 71 bp, chicken (Gallus Gallus)
  misc_feature (36): n=a or t
gtgggactttggcagacagaaacaatctgaaacgcnggtaagaaacttggtttctcccccaaaacttaaaa

SEQ ID NO: 49214 - DNA, 71 bp, chicken (Gallus Gallus)
  misc_feature (36): n=c or g
atggtacttaagaagtgaactatgtgcaaggagacncctctttaaagtaggggaagcagagaggcaaaagc

SEQ ID NO: 49215 - DNA, 71 bp, chicken (Gallus Gallus)
  misc_feature (36): n=c or g
catatcctccatcaagagggaacataggctagaaantaagcaccttttcattagcctggagtgaatacgtc

SEQ ID NO: 49216 - DNA, 71 bp, chicken (Gallus Gallus)
  misc_feature (36): n=c or g
accacagagctgggagctgtggctgagggcccccanggggaggcttttcaatttcccaaacgtgtttcagc

SEQ ID NO: 49217 - DNA, 71 bp, chicken (Gallus Gallus)
  misc_feature (36): n=a or t
gaaagatcaaataccgtataacatacatcgtattgnatgttagacttttttggaacaattctatcaaacaa

SEQ ID NO: 49218 - DNA, 71 bp, chicken (Gallus Gallus)
  misc_feature (36): n=a or t
gcctgtctatattaaaatacagcttacgttcacacntgcatgctcaagagcaaaaaaaaactcccagaaat

SEQ ID NO: 49219 - DNA, 71 bp, chicken (Gallus Gallus)
  misc_feature (36): n=a or t
agaatttgcatatagtcaaaaacaccaattcatcanttttttattgccaatttctgaagccaactttgcag

SEQ ID NO: 49220 - DNA, 71 bp, chicken (Gallus Gallus)
  misc_feature (36): n=c or g
agacgttaccaccttttccaaagctgcttccagctnacgtctcagctcatctccagagtcttcaaaatttc

SEQ ID NO: 49221 - DNA, 71 bp, chicken (Gallus Gallus)
  misc_feature (36): n=c or g
gccacttcgcgcagctcacatatttacaagtgaaanagtacaactaattatttggaaactaagaaaaaatt

SEQ ID NO: 49222 - DNA, 71 bp, chicken (Gallus Gallus)
  misc_feature (36): n=a or t
attcaagatatcagcttccatcagtcaaaacactcnaaaagtatctaaggagactgaaatgatttagcaac

SEQ ID NO: 49223 - DNA, 71 bp, chicken (Gallus Gallus)
  misc_feature (36): n=a or t
tgacagggcaaactcaacatggttctggtaagtagntcaagataagtttttgaaattggctttcctttatt

SEQ ID NO: 49224 - DNA, 71 bp, chicken (Gallus Gallus)
  misc_feature (36): n=a or t
agttgtacttcccttttcttcattacctgacagtangcttcctattcaagcaattgaacatttcacttgtc

SEQ ID NO: 49225 - DNA, 71 bp, chicken (Gallus Gallus)
  misc_feature (36): n=c or g
gctggttcagcacaccctacgagcctctaaaatttnaatctggtgtaagttcagtagtgctgaaagagcac

SEQ ID NO: 49226 - DNA, 71 bp, chicken (Gallus Gallus)
  misc_feature (36): n=c or g
taaaaatccttcttacatcttcactggcagaaattnctttgaagtacaaaggtgggtcatctttgagactt

SEQ ID NO: 49227 - DNA, 71 bp, chicken (Gallus Gallus)
  misc_feature (36): n=a or t
caagcaatcacagtaaagccaaatgttactaaaaanctctgtattatgcttgccagaaaatagacattaag

SEQ ID NO: 49228 - DNA, 71 bp, chicken (Gallus Gallus)
  misc_feature (36): n=a or t
tactgacttcattaagagcgctgtttctatatatantacctgcagatcttctcaaaaggtcacattacaaa

SEQ ID NO: 49229 - DNA, 71 bp, chicken (Gallus Gallus)
  misc_feature (36): n=c or g
tctctgcagatcctgatccaaagtgtatgtgaaacnatggtaccaaaattggttgcagaagacattccgtt

SEQ ID NO: 49230 - DNA, 71 bp, chicken (Gallus Gallus)
  misc_feature (36): n=c or g
ttcaaactttcttcattttttcattcactgttaaanaaatgagtaggaatgtctagcagtaggaagccaga

SEQ ID NO: 49231 - DNA, 71 bp, chicken (Gallus Gallus)
  misc_feature (36): n=c or g
tagcagttttgtcctcaaaatcatattcaccaatancaggcacatacttaccataaattttctttaaaaag

SEQ ID NO: 49232 - DNA, 71 bp, chicken (Gallus Gallus)
  misc_feature (36): n=a or t
tcttgagtactgttccatttgattttatgatcaatnagctataaattctcagcagacttaatgtctcttaa

SEQ ID NO: 49233 - DNA, 71 bp, chicken (Gallus Gallus)
  misc_feature (36): n=a or t
cctctcttggaaaatgttcttgatgttcttctttcnattagtgaaaattcaacaaggccaggaggctggag

SEQ ID NO: 49234 - DNA, 71 bp, chicken (Gallus Gallus)
  misc_feature (36): n=a or t
tggatatcaaaatcatgaatagttgaaaattgtttnctggctgatttgtatgtctgtactttgagtagaga

SEQ ID NO: 49235 - DNA, 71 bp, chicken (Gallus Gallus)
  misc_feature (36): n=c or g
tattgagatgggtgttcactagaaataaaaggtaanaaaagtaagctggtaactttctccaggttcagcac

SEQ ID NO: 49236 - DNA, 71 bp, chicken (Gallus Gallus)
  misc_feature (36): n=c or g
tggaaagctgtcgtagtgctttaaataatgaaaaantttcaggccttgataaatggctcagttggatgcag

SEQ ID NO: 49237 - DNA, 71 bp, chicken (Gallus Gallus)
  misc_feature (36): n=a or t
ttctacttgaccgtttccctcatttttatcaaattnaagtgtgtaatgacaagtctacaattcctgatact

SEQ ID NO: 49238 - DNA, 71 bp, chicken (Gallus Gallus)
  misc_feature (36): n=a or t
taataccaaagtttcattttctaatcttggatttgntactgatgttaaaatgataataagtccgtgttagc

SEQ ID NO: 49239 - DNA, 71 bp, chicken (Gallus Gallus)
  misc_feature (36): n=c or g
ggatctctgagcacttcacatgacaaaaaccagatntccttcagctgcaaactggaaactcatgcttagct

SEQ ID NO: 49240 - DNA, 71 bp, chicken (Gallus Gallus)
  misc_feature (36): n=a or t
cataggagaaatactttggttaattattctttcatnttctttgtcagttgcttcatatgtggaagggattt

SEQ ID NO: 49241 - DNA, 71 bp, chicken (Gallus Gallus)
  misc_feature (36): n=c or g
caagggtctcccatgccagtggggatttgccacccntgcagtgagttctcaccccagggatggtttcccct

SEQ ID NO: 49242 - DNA, 71 bp, chicken (Gallus Gallus)
  misc_feature (36): n=c or g
acctcccaggtgccaacagcttagggtttcccaagncagggagtacattaacagctaagaaaaatgggtat

SEQ ID NO: 49243 - DNA, 71 bp, chicken (Gallus Gallus)
  misc_feature (36): n=c or g
aatcccacgttacctccaaggacgccaggatgatgntagtgtcatttcaacccaccaaacaaggaacagct

SEQ ID NO: 49244 - DNA, 71 bp, chicken (Gallus Gallus)
  misc_feature (36): n=c or g
aaataatttttcctggctgtgaaaattccaaaaaanttttgggcaattgataattgaggcttctcttcctt

SEQ ID NO: 49245 - DNA, 71 bp, chicken (Gallus Gallus)
  misc_feature (36): n=a or t
tggttgtattgtagttagtggcaaaactcccacaancatcagaaaagcctcaagttcaatttgtggcagtc

SEQ ID NO: 49246 - DNA, 71 bp, chicken (Gallus Gallus)
  misc_feature (36): n=a or t
ttattatccaccaatttatactcaataatgctctanagctatttatttcagcttctcattataaatgaaaa

SEQ ID NO: 49247 - DNA, 71 bp, chicken (Gallus Gallus)
  misc_feature (36): n=a or t
ttgaaaatgccttttcaatccaatacattacctgtngggtaggccaaacttggacatttttcaccttgcca

SEQ ID NO: 49248 - DNA, 71 bp, chicken (Gallus Gallus)
  misc_feature (36): n=a or t
gagtccttcaaatggttgatttgcactcagtggacnactagacaataagcggtatgaattattggaaatca

SEQ ID NO: 49249 - DNA, 71 bp, chicken (Gallus Gallus)
  misc_feature (36): n=a or t
aaaaacagcagagaaactccttagcgtgtagaaaangctatccattgggaaggagataatctggtcttaca

SEQ ID NO: 49250 - DNA, 71 bp, chicken (Gallus Gallus)
  misc_feature (36): n=c or g
caaaaatgcttcaacaaactgaatgtgctttcattnctctttttccttgatctctcctttctcatcttaat

SEQ ID NO: 49251 - DNA, 71 bp, chicken (Gallus Gallus)
  misc_feature (36): n=a or t
gtaaaatggaggggaattagaatggtatgaattagngttagaagtaaaaatgtcttgtgtgcaaatggtag

SEQ ID NO: 49252 - DNA, 71 bp, chicken (Gallus Gallus)
  misc_feature (36): n=a or t
ggaacagaggatcttaaacctctggaattaccccanatatactgtatgccacaactgcccaaaaacaaaga

SEQ ID NO: 49253 - DNA, 71 bp, chicken (Gallus Gallus)
  misc_feature (36): n=c or g
gtgtacagcacctgtgcactgaccatggggaaaagnagttttaacccaaggtgctgcacactgtgatacct

SEQ ID NO: 49254 - DNA, 71 bp, chicken (Gallus Gallus)
  misc_feature (36): n=c or g
acagtaattggaaagatatgtgggagtagtacagtnagagattttgtcaagaaaccaaggatgtcacacac

SEQ ID NO: 49255 - DNA, 71 bp, chicken (Gallus Gallus)
  misc_feature (36): n=a or t
tatgaggaaggcatttttcagccacaatagcattcngcaacaatatctacatgcctggtagagatccacag

SEQ ID NO: 49256 - DNA, 71 bp, chicken (Gallus Gallus)
  misc_feature (36): n=a or t
actatttatatcatggcacacttttcttaaatttcntttatttcagtcatactccatattcagaaacgtct

SEQ ID NO: 49257 - DNA, 71 bp, chicken (Gallus Gallus)
  misc_feature (36): n=a or t
aatgttaaattcctgtattgatctaaaaaacttgantgttcagtttgtttctttcaacatgtaatttgatt

SEQ ID NO: 49258 - DNA, 71 bp, chicken (Gallus Gallus)
  misc_feature (36): n=a or t
taagctctaacacagaggcagcatcaactttttttnatgagattgatgttgctctgtacgatagcctcacc

SEQ ID NO: 49259 - DNA, 71 bp, chicken (Gallus Gallus)
  misc_feature (36): n=a or t
actttctcagattcattgttataataggattgaatnatcctcttgagtaggcaaaatcatgtcttttaatc

SEQ ID NO: 49260 - DNA, 71 bp, chicken (Gallus Gallus)
  misc_feature (36): n=c or g
atcaggagccgtaagtcccgattcatttggaacaangttgggcagagcactgtgccatgttgcagagctgc

SEQ ID NO: 49261 - DNA, 71 bp, chicken (Gallus Gallus)
  misc_feature (36): n=a or t
tttaatgctcttaatatcatcttctgttctgttaantgacctttttattcattcagtcgttcagttttaat

SEQ ID NO: 49262 - DNA, 71 bp, chicken (Gallus Gallus)
  misc_feature (36): n=a or t
gttgagtttccagatggaaagccaacccagaaaacntgagaccttggtttgcttaaggaaattaagagttg

SEQ ID NO: 49263 - DNA, 71 bp, chicken (Gallus Gallus)
  misc_feature (36): n=c or g
caggaatatttaaaacttctagggaagaaaaagccntcatgaagtaaaagtgttttcggatttttgatctg

SEQ ID NO: 49264 - DNA, 71 bp, chicken (Gallus Gallus)
  misc_feature (36): n=a or t
tgactatctagattccagtttgaatacaaatagagnatatagttttgtatatgtctgtcattattctaagc

SEQ ID NO: 49265 - DNA, 71 bp, chicken (Gallus Gallus)
  misc_feature (36): n=c or g
tccatgagactctttttggtgttactaatgttgttntcacatgcagggtcttctgaacttgtccaatacac

SEQ ID NO: 49266 - DNA, 71 bp, chicken (Gallus Gallus)
  misc_feature (36): n=a or t
tggcaaatgtggaaacataataaacatggtggttcntgcttcctttactaacataagctttttaatcaaag

SEQ ID NO: 49267 - DNA, 71 bp, chicken (Gallus Gallus)
  misc_feature (36): n=a or t
aattcttactgaaaattgtctggttacaaaatggtnctaaatgcaagcaaaatacaattgttggaagaaca

SEQ ID NO: 49268 - DNA, 71 bp, chicken (Gallus Gallus)
  misc_feature (36): n=c or g
ggtcagttttagaattcagtaaaatatctgctaggnatcaggttaaataaaacaaagtgagaaaggacaga

SEQ ID NO: 49269 - DNA, 71 bp, chicken (Gallus Gallus)
  misc_feature (36): n=a or t
ttttgagggccttgtgagtttaggagtactagtttnagagcttgtatttcttcaccagaagttaatgaatt

SEQ ID NO: 49270 - DNA, 71 bp, chicken (Gallus Gallus)
  misc_feature (36): n=a or t
aatagatcacattaaaagcacaagaaggcatagagnattctttaggtctgtcacgcaaaaaaatcctgtgt

SEQ ID NO: 49271 - DNA, 71 bp, chicken (Gallus Gallus)
  misc_feature (36): n=c or g
cttctgctatgaaggatcaccaaaaaattgcatatncagtagaactgccgtattttcatataggaaataca

SEQ ID NO: 49272 - DNA, 71 bp, chicken (Gallus Gallus)
  misc_feature (36): n=a or t
gctcatccttcatgaaaaagtccggctgggttcaanagggatgaaagtaatggtgaacattctgcaatgat

SEQ ID NO: 49273 - DNA, 71 bp, chicken (Gallus Gallus)
  misc_feature (36): n=c or g
actgctctctaatacaaccaggctggcaaaacatgntggttgaaatggaattgagaaatgagcagcattag

SEQ ID NO: 49274 - DNA, 71 bp, chicken (Gallus Gallus)
  misc_feature (36): n=c or g
tcccgcctcaaagccccggcgccgaactgcgggtcngctccccgagcagcgatcggatttaaatcagtgcc

SEQ ID NO: 49275 - DNA, 71 bp, chicken (Gallus Gallus)
  misc_feature (36): n=c or g
ataccttacattgtaatgcattggtgagaactgttntgtttgtttcttcattttgaactactgttagtaat

SEQ ID NO: 49276 - DNA, 71 bp, chicken (Gallus Gallus)
  misc_feature (36): n=a or t
acatttagagggtaataggttgccttgagaggtatnactaatgatttataccacaagacgtgtaataaata

SEQ ID NO: 49277 - DNA, 71 bp, chicken (Gallus Gallus)
  misc_feature (36): n=c or g
gcccaactccaagcaggacaacaacctcagcacccncacgccatgggctgcgtatttcagccagggcacag

SEQ ID NO: 49278 - DNA, 71 bp, chicken (Gallus Gallus)
  misc_feature (36): n=c or g
gatgatttccttctgcaaatatctttattctccttntataaagaagaacattaaatactttatcttcaaaa

SEQ ID NO: 49279 - DNA, 71 bp, chicken (Gallus Gallus)
  misc_feature (36): n=a or t
tgtgccctgtgaggcttcaaggactgacatttcaanactcacattctgcactactcgagtttgcttctgtt

SEQ ID NO: 49280 - DNA, 71 bp, chicken (Gallus Gallus)
  misc_feature (36): n=c or g
caacagccccagagggaacctgctgaggaagcagancccgtgctcagccctcacctcttccacacctctgc

SEQ ID NO: 49281 - DNA, 71 bp, chicken (Gallus Gallus)
  misc_feature (36): n=c or g
tcaaccatctagttaaaggctgcctccagaagctanaaaagaaagctgggcttattttcaggtgaaacagg

SEQ ID NO: 49282 - DNA, 71 bp, chicken (Gallus Gallus)
  misc_feature (36): n=a or t
ctgttacccccactgtttgatactaagatgttgagntgagttgcccatgaccacagggaaaattactatta

SEQ ID NO: 49283 - DNA, 71 bp, chicken (Gallus Gallus)
  misc_feature (36): n=c or g
tccttgctttcgcctcgcctctgcgatctgcagtgntttatatgcgtaggaacaagtgagctcatttgcag

SEQ ID NO: 49284 - DNA, 71 bp, chicken (Gallus Gallus)
  misc_feature (36): n=c or g
caactgtgataccagtgacatgggagtgccttttanatggatgatgttactcgttgctgcataggcttttt

SEQ ID NO: 49285 - DNA, 71 bp, chicken (Gallus Gallus)
  misc_feature (36): n=a or t
ctagctaacaaatgcgttccctacatttttccaacnttatgacaaatgcctttgctcagtcttactgctgg

SEQ ID NO: 49286 - DNA, 71 bp, chicken (Gallus Gallus)
  misc_feature (36): n=c or g
gttctgttcttgggcttccttgtgttatgaataaantggcaaattttggaggacagagataccacagtagg

SEQ ID NO: 49287 - DNA, 71 bp, chicken (Gallus Gallus)
  misc_feature (36): n=c or g
agtgaagagtaaaaagagctatctgagaaaataaantctgaaattaggcaggaaaagaagggattgggaat

SEQ ID NO: 49288 - DNA, 71 bp, chicken (Gallus Gallus)
  misc_feature (36): n=a or t
tattttgatcccccttcccagccacctaagagcacngaattagaggcgttaagaggcagtaattcttatct

SEQ ID NO: 49289 - DNA, 71 bp, chicken (Gallus Gallus)
  misc_feature (36): n=a or t
ctctttcccctactacaagtattacaattatttatncagcagctatctaatttccttctttccactaatat

SEQ ID NO: 49290 - DNA, 71 bp, chicken (Gallus Gallus)
  misc_feature (36): n=a or t
ctgaaagggtagttaaggcatttactattttctcanggtattagcaaacacagtccttccattaattctat

SEQ ID NO: 49291 - DNA, 71 bp, chicken (Gallus Gallus)
  misc_feature (36): n=c or g
tgtctccagctgcaggaatagagtgttgaactgaanccatgacagccactgaatcattcattagcttgccg

SEQ ID NO: 49292 - DNA, 71 bp, chicken (Gallus Gallus)
  misc_feature (36): n=a or t
catgcatgaattgtactaagcagacagatgctggcngtcattgcgttagttgcagctacgtgtctgtctgt

SEQ ID NO: 49293 - DNA, 71 bp, chicken (Gallus Gallus)
  misc_feature (36): n=c or g
tacatggaaatccagtccccatcttgcactcttccngtcagaaatatctgggcagtatttcccatcccagg

SEQ ID NO: 49294 - DNA, 71 bp, chicken (Gallus Gallus)
  misc_feature (36): n=c or g
gcttctctgaccatccagctccaatacttacctctntaactttgtgtgaccacaaatgccagaattggtta

SEQ ID NO: 49295 - DNA, 71 bp, chicken (Gallus Gallus)
  misc_feature (36): n=c or g
tcagacttgattggctgcagcgttgttccacggcanattactttctttgttcaccgagcacagccctgtgc

SEQ ID NO: 49296 - DNA, 71 bp, chicken (Gallus Gallus)
  misc_feature (36): n=a or t
ttgcaagtcagaccacagaaattatttgagaaaggntactcgatcccatcctataatttcatgtttgtcac

SEQ ID NO: 49297 - DNA, 71 bp, chicken (Gallus Gallus)
  misc_feature (36): n=c or g
cttattcaagagaggagatgggatacttctgagttnatttaacagtacatgggagtgtgtaggctgacact

SEQ ID NO: 49298 - DNA, 71 bp, chicken (Gallus Gallus)
  misc_feature (36): n=c or g
tcacaaagtatgtgagaattacagattgaagacagncacttttaggttgtcagctaagtccaatagatctt

SEQ ID NO: 49299 - DNA, 71 bp, chicken (Gallus Gallus)
  misc_feature (36): n=a or t
ttttttaaacgtgtatttcaattgttaaccgtaatngagataatactgcaaaaatgtgtgtagcttattga

SEQ ID NO: 49300 - DNA, 71 bp, chicken (Gallus Gallus)
  misc_feature (36): n=a or t
aatgctgttcctgggtttacaagttcataaattatncttatgatgatattctcagacatattaaacatact

SEQ ID NO: 49301 - DNA, 71 bp, chicken (Gallus Gallus)
  misc_feature (36): n=c or g
aattaagaataaacaacaacatagtagaattttttnttttccacaaatctgcccatccatctcagagtagt

SEQ ID NO: 49302 - DNA, 71 bp, chicken (Gallus Gallus)
  misc_feature (36): n=a or t
ttttcacttctgaaactgattataaacaaggccatnaaatacatcccactattaaaagtcattttcatgtt

SEQ ID NO: 49303 - DNA, 71 bp, chicken (Gallus Gallus)
  misc_feature (36): n=c or g
gctggtgtcaggcctgcccaggccggacattagtangagggctgcttttccagttggtttgcacagctgca

SEQ ID NO: 49304 - DNA, 71 bp, chicken (Gallus Gallus)
  misc_feature (36): n=c or g
tacagtgtgatgaaattcctcaaaataccactcaangaaaagtgttccaatctcctgggcagtttggttgt

SEQ ID NO: 49305 - DNA, 71 bp, chicken (Gallus Gallus)
  misc_feature (36): n=a or t
gctcgttaggaactactttgcctattaaagctcatngttagagataagagtctctcttggtcccttctatg

SEQ ID NO: 49306 - DNA, 71 bp, chicken (Gallus Gallus)
  misc_feature (36): n=c or g
agcaggaatgtttcactaggggcattttggcaaggnttgctggccctccatgagcaaagtgggaaaatacc

SEQ ID NO: 49307 - DNA, 71 bp, chicken (Gallus Gallus)
  misc_feature (36): n=c or g
tcagcttaagaaataacattactttgttctatggtnttatgaactaacttggcttcttgaaaaacttccat

SEQ ID NO: 49308 - DNA, 71 bp, chicken (Gallus Gallus)
  misc_feature (36): n=c or g
aattaagaattctgtaagtaagaaaatgggtacaanattttgtcttctcacaagtttcttttaaactatag

SEQ ID NO: 49309 - DNA, 71 bp, chicken (Gallus Gallus)
  misc_feature (36): n=a or t
gaggttgctggtgttggggatgcatgtttttttttnaatctaattaaccccaaacagcattatggctcctt

SEQ ID NO: 49310 - DNA, 71 bp, chicken (Gallus Gallus)
  misc_feature (36): n=a or t
gttctatatgtaaaacagcccactccctgatatatntggtgatagtctgaaatgacttcatgcttcccagc

SEQ ID NO: 49311 - DNA, 71 bp, chicken (Gallus Gallus)
  misc_feature (36): n=c or g
tcagagttaagcaaaaaggcaagttaaaaatcctgncatgtaattttacttcaagaatagtccaccagacc

SEQ ID NO: 49312 - DNA, 71 bp, chicken (Gallus Gallus)
  misc_feature (36): n=c or g
ctttttctaacatgtagttagtggttttcctttcantgaagctagggggattcaaggatgtaggtgcctaa

SEQ ID NO: 49313 - DNA, 71 bp, chicken (Gallus Gallus)
  misc_feature (36): n=c or g
agatgacacgctatgaaatccatctgatgcacaaanaattcctcttttcacagcatcagggcactgaaatc

SEQ ID NO: 49314 - DNA, 71 bp, chicken (Gallus Gallus)
  misc_feature (36): n=c or g
agctctctcttacattgatagcttgtttgcttaacnaaacacaaaccttttctcatcgctgttaaattcac

SEQ ID NO: 49315 - DNA, 71 bp, chicken (Gallus Gallus)
  misc_feature (36): n=c or g
aacatgatcagaactgcttagaggacagctgaaaantcacgtataactagtttcccagctgccttcttgtc

SEQ ID NO: 49316 - DNA, 71 bp, chicken (Gallus Gallus)
  misc_feature (36): n=c or g
gataaacaggtaaacatgcagctccattttttactntatcattaggacagaatcagaatgccaaattttcc

SEQ ID NO: 49317 - DNA, 71 bp, chicken (Gallus Gallus)
  misc_feature (36): n=c or g
cagatcctgcagacggaagcagcctggtttccccanagtggcatccccatggtgctgcaaagaggagccca

SEQ ID NO: 49318 - DNA, 71 bp, chicken (Gallus Gallus)
  misc_feature (36): n=c or g
ggtccatattagcaacaccttaccttcaggcaggangttaaaaccacattatctccaaagctagagctcct

SEQ ID NO: 49319 - DNA, 71 bp, chicken (Gallus Gallus)
  misc_feature (36): n=a or t
agagaatacatgaaggattctgaggaatccaaccanaggggctgaaattgtttaagagaaagatgagacaa

SEQ ID NO: 49320 - DNA, 71 bp, chicken (Gallus Gallus)
  misc_feature (36): n=a or t
aatctctacaaccactgccatatttttccatgggcntttttcttcactgcttggaatcataacaatacaca

SEQ ID NO: 49321 - DNA, 71 bp, chicken (Gallus Gallus)
  misc_feature (36): n=a or t
ttaacactcactgaaattcagttgggaatcatacantgtaaaagccaggaaagggatactcccattagcat

SEQ ID NO: 49322 - DNA, 71 bp, chicken (Gallus Gallus)
  misc_feature (36): n=c or g
gaacactgctgcctatgaataaatgcattcaaattntatcatccttttttcattagaagcagtatttcgat

SEQ ID NO: 49323 - DNA, 71 bp, chicken (Gallus Gallus)
  misc_feature (36): n=c or g
acaaaaatgcaggctgatatttctaatgatattaangaactgagcgtaacaggaatttcggttatgaacca

SEQ ID NO: 49324 - DNA, 71 bp, chicken (Gallus Gallus)
  misc_feature (36): n=c or g
caagttagcagcgttcaaagttgtaatagctgctcntagatgttagaagcatacaaaatgtatctaaaata

SEQ ID NO: 49325 - DNA, 71 bp, chicken (Gallus Gallus)
  misc_feature (36): n=c or g
tgataattccaagaccttcaccagtattccttacanaaacactgacttaccctgtgttttgttgatggagt

SEQ ID NO: 49326 - DNA, 71 bp, chicken (Gallus Gallus)
  misc_feature (36): n=c or g
ttgcatcactgttctgcctctgttcagcaaagtcancgggaagagctgcatcctgcatggatgctccagca

SEQ ID NO: 49327 - DNA, 71 bp, chicken (Gallus Gallus)
  misc_feature (36): n=c or g
ttaatttgccacttttgaatgctgatggtctatcanctcacaacatatcagttctatattagttctagagt

SEQ ID NO: 49328 - DNA, 71 bp, chicken (Gallus Gallus)
  misc_feature (36): n=a or t
ccctctgcaagtaggcagagccttgaagaaaggagncagtatctgatggagcaagaatactggtaggaaga

SEQ ID NO: 49329 - DNA, 71 bp, chicken (Gallus Gallus)
  misc_feature (36): n=a or t
ttttattgatcctgtctgcacttttcctgaggtcanactctggttttactcctgcttacttggtctggatg

SEQ ID NO: 49330 - DNA, 71 bp, chicken (Gallus Gallus)
  misc_feature (36): n=c or g
agatttcatgggctagagattacattttcatcaccnttatgcatatgaagtcttttaatttctataaatct

SEQ ID NO: 49331 - DNA, 71 bp, chicken (Gallus Gallus)
  misc_feature (36): n=c or g
gcgggggttgctccgggttgccggagacgcgccatncagccgccaggatgcctgctgccgtgaaaggatcg

SEQ ID NO: 49332 - DNA, 71 bp, chicken (Gallus Gallus)
  misc_feature (36): n=c or g
tttggagagcactgggaagtgctggcgtgccgctgncctttagcctcacaccgcattgcccacatccccac

SEQ ID NO: 49333 - DNA, 71 bp, chicken (Gallus Gallus)
  misc_feature (36): n=c or g
ttgaagaggcctttctaattttaagctatagcttangttcataatttcttgtctgtgctggctggcagttt

SEQ ID NO: 49334 - DNA, 71 bp, chicken (Gallus Gallus)
  misc_feature (36): n=a or t
ttagactatacgctttctcagataaggtaatgcagntttgcaatcaaaaaagtaaattgtgccgtaagatt

SEQ ID NO: 49335 - DNA, 71 bp, chicken (Gallus Gallus)
  misc_feature (36): n=a or t
ctaattggtactataaatttgtgtaggaaataagangacagtggtgattactactgaatgcatgaaagtgt

SEQ ID NO: 49336 - DNA, 71 bp, chicken (Gallus Gallus)
  misc_feature (36): n=a or t
ttgtggagctttctaaatgtactactatacaggctntgaatttaccaatcttcagtagactaattagtaac

SEQ ID NO: 49337 - DNA, 71 bp, chicken (Gallus Gallus)
  misc_feature (36): n=a or t
aatctttgtatagtggggaaggctaacagtttattnccccataaaatgtgaacaactttgatctatggagg

SEQ ID NO: 49338 - DNA, 71 bp, chicken (Gallus Gallus)
  misc_feature (36): n=a or t
aacgtgccactagatctgccttaacgttccactgangcttgtattttgttcccgataaacaagaaattggg

SEQ ID NO: 49339 - DNA, 71 bp, chicken (Gallus Gallus)
  misc_feature (36): n=a or t
gacagtgaggtgtctgagggaacctttactgtattntcctgaagtaggtctaccaaaatcactgagctcac

SEQ ID NO: 49340 - DNA, 71 bp, chicken (Gallus Gallus)
  misc_feature (36): n=c or g
aaacgtgtgcagagatggatttgagagcagcagganaaaggctggtggttctgggcaggctgtgggaaggg

SEQ ID NO: 49341 - DNA, 71 bp, chicken (Gallus Gallus)
  misc_feature (36): n=a or t
atgtgaagtgtttgagtatgttgtgaactggtttgnttctgttgttgaccctttcttctgtcagagtaggt

SEQ ID NO: 49342 - DNA, 71 bp, chicken (Gallus Gallus)
  misc_feature (36): n=c or g
aggaacagctgccgttggctcagcacagccccgcgntgaggcacaaacagagggacccaaagaaccctcgc

SEQ ID NO: 49343 - DNA, 71 bp, chicken (Gallus Gallus)
  misc_feature (36): n=c or g
agtcctgaaataacctaaaccccaaaatctaaaatncttgaaaaaagaatcctactatttgagacagtact

SEQ ID NO: 49344 - DNA, 71 bp, chicken (Gallus Gallus)
  misc_feature (36): n=c or g
aaagaaaaaaggaaaacaacctactgagctgagaantttatcacaaataaggagtactactactttgcatt

SEQ ID NO: 49345 - DNA, 71 bp, chicken (Gallus Gallus)
  misc_feature (36): n=a or t
agctaagtatagcactagagagtactaagtatatantataaagatgattttaatattttgtctgcaagcaa

SEQ ID NO: 49346 - DNA, 71 bp, chicken (Gallus Gallus)
  misc_feature (36): n=a or t
aacacttctgagtattatcaacttaggataaaacangtaattattaaaaatctacctatagccttttttac

SEQ ID NO: 49347 - DNA, 71 bp, chicken (Gallus Gallus)
  misc_feature (36): n=a or t
agctcaagtttaaagagatactgtctttaataatantagttagattgaagaaattttcatgttagctatgt

SEQ ID NO: 49348 - DNA, 71 bp, chicken (Gallus Gallus)
  misc_feature (36): n=a or t
ctgccagtgaagaggagtttcataaggagtctcacngctgagttttctgattgtcactatcaggtggtcta

SEQ ID NO: 49349 - DNA, 71 bp, chicken (Gallus Gallus)
  misc_feature (36): n=a or t
ttccaaatttattacacacaacagatatgtgcacanatacacatggagactagcaactaggcagaaaaaga

SEQ ID NO: 49350 - DNA, 71 bp, chicken (Gallus Gallus)
  misc_feature (36): n=c or g
tcacttctccaggctggaactattttgcttctactnaactggtagaagtgaaggaaaacactctctcatgc

SEQ ID NO: 49351 - DNA, 71 bp, chicken (Gallus Gallus)
  misc_feature (36): n=a or t
gtccctcagactcttaataaatcagaaacaacagangttttgtgtgcaaatttggttgctaattagctttt

SEQ ID NO: 49352 - DNA, 71 bp, chicken (Gallus Gallus)
  misc_feature (36): n=c or g
tcagctgaagaagagttcactcactgagacctcacntctacaatcactaccgtagaaaaagccacccaaat

SEQ ID NO: 49353 - DNA, 71 bp, chicken (Gallus Gallus)
  misc_feature (36): n=a or t
gaagcattaattatgacagaaatgaatgcagtctgnaaaagaacttttctatgatactagtttcacaatgg

SEQ ID NO: 49354 - DNA, 71 bp, chicken (Gallus Gallus)
  misc_feature (36): n=a or t
ggacactataattaaagatggaatgcagattctgtntggtgcattttggtaggcagacttcatagagttaa

SEQ ID NO: 49355 - DNA, 71 bp, chicken (Gallus Gallus)
  misc_feature (36): n=a or t
tctatttatgtatcacagttgaataaaatgtttaantagccaagataaattcagttcaaataggaacaata

SEQ ID NO: 49356 - DNA, 71 bp, chicken (Gallus Gallus)
  misc_feature (36): n=c or g
ggtataaaaggcacatccagatgggagtccacctgnatttctgaaagaccttaaaagaaactatgagaggc

SEQ ID NO: 49357 - DNA, 71 bp, chicken (Gallus Gallus)
  misc_feature (36): n=c or g
actccaagagctgggtcccatgacctggattcattncatctaagggaggtgcacagatgagccagtttagt

SEQ ID NO: 49358 - DNA, 71 bp, chicken (Gallus Gallus)
  misc_feature (36): n=c or g
agagaaacacacaccagggctgaacttcaccaaagntcagatctgaaagagggagaggtgggagtggggga

SEQ ID NO: 49359 - DNA, 71 bp, chicken (Gallus Gallus)
  misc_feature (36): n=a or t
aatatcacctctccttaaagcctgccttaggctgtngcagaaactcatgtagaagacttaagccctttttg

SEQ ID NO: 49360 - DNA, 71 bp, chicken (Gallus Gallus)
  misc_feature (36): n=a or t
ttcttggaagttgaccatcctggccaaactttgacnttaggcctgctttgcttagggatctggactaggtc

SEQ ID NO: 49361 - DNA, 71 bp, chicken (Gallus Gallus)
  misc_feature (36): n=a or t
ttaaattaggtaaaatttctactcagcagagagtgncaggaatgtctatgtgtttgaaagggattatttca

SEQ ID NO: 49362 - DNA, 71 bp, chicken (Gallus Gallus)
  misc_feature (36): n=c or g
ttgctgcttcttagctcttctctgacagactagatntagattgacacaatgtgtgcacagctgcactcttt

SEQ ID NO: 49363 - DNA, 71 bp, chicken (Gallus Gallus)
  misc_feature (36): n=a or t
tcttttgttgacaacaaagagcacttatgtgacatngcacaacttaactgctctactgtcaaagtaactgc

SEQ ID NO: 49364 - DNA, 71 bp, chicken (Gallus Gallus)
  misc_feature (36): n=a or t
cacctcaggaatggaattttccagcaatcactgccngcagataagggaacttccacccgtctgcccacccc

SEQ ID NO: 49365 - DNA, 71 bp, chicken (Gallus Gallus)
  misc_feature (36): n=c or g
aggacattctgcagttatgttcacccagtcacaaanagtttactctatttgcacagttaggagactatagt

SEQ ID NO: 49366 - DNA, 71 bp, chicken (Gallus Gallus)
  misc_feature (36): n=c or g
ccctgaagccctctttagacatttacataatgtttncttcctctcatgcctttgagactgaaacaaagttg

SEQ ID NO: 49367 - DNA, 71 bp, chicken (Gallus Gallus)
  misc_feature (36): n=a or t
tgcccacagtgggagcctcgtcagaactctgacagntctctgcagaactggtgcttccttgtgcttggtcc

SEQ ID NO: 49368 - DNA, 71 bp, chicken (Gallus Gallus)
  misc_feature (36): n=c or g
ctgaagtgactgttcccttcaaactggtgggagctnagcacaggagaaaaaagaatccctcccaaaatttg

SEQ ID NO: 49369 - DNA, 71 bp, chicken (Gallus Gallus)
  misc_feature (36): n=a or t
gctgtggacctggttcctctaatgaagattctcatnacagaaaatgccttcatctgagttggaaaacaaat

SEQ ID NO: 49370 - DNA, 71 bp, chicken (Gallus Gallus)
  misc_feature (36): n=c or g
aatggaggcagacaggagtctggtaaaagggaaggngtaatggtgtgacagaagaagaagacactattaaa

SEQ ID NO: 49371 - DNA, 71 bp, chicken (Gallus Gallus)
  misc_feature (36): n=c or g
gccgatctgtatgcacggctgctggtcaccgctgangactctgcaaaaaggtatttaccaaaaagccgtgc

SEQ ID NO: 49372 - DNA, 71 bp, chicken (Gallus Gallus)
  misc_feature (36): n=c or g
aatggtggggtctttccagcaaacatttcccaaacnctaagaagcagaactggagtcagcctgctttagct

SEQ ID NO: 49373 - DNA, 71 bp, chicken (Gallus Gallus)
  misc_feature (36): n=a or t
ataatggctttcaaattctacaacttttcaaggtgnaatcatggcattgtaagccctgtgtttcttttatc

SEQ ID NO: 49374 - DNA, 71 bp, chicken (Gallus Gallus)
  misc_feature (36): n=a or t
ccagcaaaatctgtgctttcagaagggtacagaaangactgcagattcaagaggtgacttttataagaaag

SEQ ID NO: 49375 - DNA, 71 bp, chicken (Gallus Gallus)
  misc_feature (36): n=c or g
tttttgttgtagaataattatctgtaactacagctntttttggtgttccacttctacatagtcctctcatc

SEQ ID NO: 49376 - DNA, 71 bp, chicken (Gallus Gallus)
  misc_feature (36): n=c or g
aaagctaaagccagttaccaggctttggaaagacancatttagcagtgcacaagtgttgcaaaacacaaac

SEQ ID NO: 49377 - DNA, 71 bp, chicken (Gallus Gallus)
  misc_feature (36): n=c or g
atgtagctaatctgcacttacaattatttccacttntaactccagtaggactctcttttggggtgttcaga

SEQ ID NO: 49378 - DNA, 71 bp, chicken (Gallus Gallus)
  misc_feature (36): n=c or g
gaatttttcagcattgtttgttaaccctagatttanacagcatccagcaatttaatgtcttgcagagacta

SEQ ID NO: 49379 - DNA, 71 bp, chicken (Gallus Gallus)
  misc_feature (36): n=c or g
ttcaacaatcacccgtgtctactcatgcatgctacntactctcattgctgatgcttatgccaatctgaagt

SEQ ID NO: 49380 - DNA, 71 bp, chicken (Gallus Gallus)
  misc_feature (36): n=c or g
acacagacagggtccggcaggttcctattctccctnacagtggaggttactgacaggcctcaggagaactt

SEQ ID NO: 49381 - DNA, 71 bp, chicken (Gallus Gallus)
  misc_feature (36): n=c or g
ttcatttcctgaactgcaggcttgctgcaaagaggnctattttgagtgaaacctctagcaggacagcatcc

SEQ ID NO: 49382 - DNA, 71 bp, chicken (Gallus Gallus)
  misc_feature (36): n=c or g
gctgttctgctgcgctttgttttaggtggctgttangtaaagtaaaacagaagggtgtgatccagcacagg

SEQ ID NO: 49383 - DNA, 71 bp, chicken (Gallus Gallus)
  misc_feature (36): n=c or g
ctggatgctgctctgtgatgctctaaggggtgaagnagtaggaaaaaaaagccctatagttcataggttct

SEQ ID NO: 49384 - DNA, 71 bp, chicken (Gallus Gallus)
  misc_feature (36): n=a or t
ttaggagaaaggacaaagaacacatggagcagatcngttcacatgagggagatcagctagagctcataatc

SEQ ID NO: 49385 - DNA, 71 bp, chicken (Gallus Gallus)
  misc_feature (36): n=a or t
tttcttgttctaattatttctgggcaagctattaanagacttttcagatttggaatttgttggaatgtttt

SEQ ID NO: 49386 - DNA, 71 bp, chicken (Gallus Gallus)
  misc_feature (36): n=a or t
gcaatgtcatctaccattgcatcatgttgcttggcnctgtgcagagggaagaatgcttatctggggaaatg

SEQ ID NO: 49387 - DNA, 71 bp, chicken (Gallus Gallus)
  misc_feature (36): n=a or t
ctaaaatgttcttaaaagttttagttggtggttatntcatttgagagttatggatctgtatgtaaaaatag

SEQ ID NO: 49388 - DNA, 71 bp, chicken (Gallus Gallus)
  misc_feature (36): n=a or t
ttgaagcagactgctggtacttgcaaggagtgagantcttttttgaagatagcatctgctcttgctgatgc

SEQ ID NO: 49389 - DNA, 71 bp, chicken (Gallus Gallus)
  misc_feature (36): n=a or t
agaagaagcacctgtaagtttcctgagttacctccngagggcaaattatatttaacatatgacgtactggt

SEQ ID NO: 49390 - DNA, 71 bp, chicken (Gallus Gallus)
  misc_feature (36): n=a or t
tgtgattttttaacacaaggaaagtttcaacagttnggacacaacagactaaaatatgacatttcttccct

SEQ ID NO: 49391 - DNA, 71 bp, chicken (Gallus Gallus)
  misc_feature (36): n=a or t
atcagtcccaacacaatctctcttccttgcagtaanataaaattacagataatacaaagatcagccccttc

SEQ ID NO: 49392 - DNA, 71 bp, chicken (Gallus Gallus)
  misc_feature (36): n=a or t
atttctgaattcctttgttacttaccaaaatattanaattatcctggtagttttggcaggaagctagtcac

SEQ ID NO: 49393 - DNA, 71 bp, chicken (Gallus Gallus)
  misc_feature (36): n=c or g
ttccctgaacatcaagtataacagacctttgccttnttgctaatgaataacacatatttaaatcccagttg

SEQ ID NO: 49394 - DNA, 71 bp, chicken (Gallus Gallus)
  misc_feature (36): n=c or g
acattaagaatctgcatcatatcatttctgttaaantttaaatctggacacaattcagcctcagattcaca

SEQ ID NO: 49395 - DNA, 71 bp, chicken (Gallus Gallus)
  misc_feature (36): n=c or g
tactatatgtgcaacaatttctggtaacaatgccancgtcatagctgtgacactgtggttcacctccactg

SEQ ID NO: 49396 - DNA, 71 bp, chicken (Gallus Gallus)
  misc_feature (36): n=a or t
tggggtgaaagagaggaaactgttcttaatgtcccnatttgaagcctttctgcagaacttacaatttaagt

SEQ ID NO: 49397 - DNA, 71 bp, chicken (Gallus Gallus)
  misc_feature (36): n=c or g
gagccacacaacctcagggctggatttcctgatganattcagtagtgtggttttcttggctttgcagttaa

SEQ ID NO: 49398 - DNA, 71 bp, chicken (Gallus Gallus)
  misc_feature (36): n=c or g
gaatgggaagcagctgagcactctgcctctccctanagttcatctgcacctcatgacacattgatttcttg

SEQ ID NO: 49399 - DNA, 71 bp, chicken (Gallus Gallus)
  misc_feature (36): n=a or t
tttaacatcagctttctctcaaaaaatcagcattanattctgtcaccttccacaattgagaaaggaatcag

SEQ ID NO: 49400 - DNA, 71 bp, chicken (Gallus Gallus)
  misc_feature (36): n=c or g
ttttcacaggaaggtgacatttagatggtttaatancatacaatgaaagtaaggaaaagggaaggagacaa

SEQ ID NO: 49401 - DNA, 71 bp, chicken (Gallus Gallus)
  misc_feature (36): n=c or g
agtaccagaagcaatatgagcttaatatgagctcanaggaccgtgcaatacaagcataattgactcactgc

SEQ ID NO: 49402 - DNA, 71 bp, chicken (Gallus Gallus)
  misc_feature (36): n=c or g
cgcaacgcacagccctgtgatgggtgctgagctcanagcccgagcgctgcaaaacagccctgcacggctcc

SEQ ID NO: 49403 - DNA, 71 bp, chicken (Gallus Gallus)
  misc_feature (36): n=c or g
acgacttttatagtgttgaaagaatatgcatgcttnagggaacatcaattgggctctctctaaagctgaaa

SEQ ID NO: 49404 - DNA, 71 bp, chicken (Gallus Gallus)
  misc_feature (36): n=a or t
ttcaatttatatggaataatttaattacaagcatcnctaacatttcagttactttgtgttctcatatgctg

SEQ ID NO: 49405 - DNA, 71 bp, chicken (Gallus Gallus)
  misc_feature (36): n=c or g
gcagccaggttatcagctcacctgctctcgtgttanctgtctgccatctggacacccagcctgggctgcct

SEQ ID NO: 49406 - DNA, 71 bp, chicken (Gallus Gallus)
  misc_feature (36): n=a or t
cagggcctttagcaatctttccaattaagttggtanatttaacgttatagagacttatctctgtaagaagt

SEQ ID NO: 49407 - DNA, 71 bp, chicken (Gallus Gallus)
  misc_feature (36): n=c or g
aagaaattaacagaaaagaactggatattgctgtgnttaggtagtctcagagctcacttcttcaagcttct

SEQ ID NO: 49408 - DNA, 71 bp, chicken (Gallus Gallus)
  misc_feature (36): n=a or t
tttttttgttttatttcaagactggtagcacagaantgatcacctgtgagcagtactataactagtgtggt

SEQ ID NO: 49409 - DNA, 71 bp, chicken (Gallus Gallus)
  misc_feature (36): n=a or t
tgtattattgagtattgttttgtaggctatcaaggnctttttacactaaaagtctgatgctggaaagggag

SEQ ID NO: 49410 - DNA, 71 bp, chicken (Gallus Gallus)
  misc_feature (36): n=c or g
tggctagtataaatacgaatcataatttatactatnctcatccatgtaaatagtttctctactggtgattt

SEQ ID NO: 49411 - DNA, 71 bp, chicken (Gallus Gallus)
  misc_feature (36): n=c or g
agaacagtttggtcatctgcatgaagagctactctnttttaacattgtttcagacatctgaaaggtaaata

SEQ ID NO: 49412 - DNA, 71 bp, chicken (Gallus Gallus)
  misc_feature (36): n=a or t
ctagagggctattgtccaatggctatatgtccaggnggaggctgttcatgaatgctttccccaggctgtcc

SEQ ID NO: 49413 - DNA, 71 bp, chicken (Gallus Gallus)
  misc_feature (36): n=a or t
tccaccactaattgaataattatcatctttttgccnagccatctctgaagcattactacactattactttt

SEQ ID NO: 49414 - DNA, 71 bp, chicken (Gallus Gallus)
  misc_feature (36): n=c or g
taaagggtaattaagtcactctcggtctggaaatanctgatgggtgtttcctggtttgactattaagtttt

SEQ ID NO: 49415 - DNA, 71 bp, chicken (Gallus Gallus)
  misc_feature (36): n=a or t
tggcatggtgtggaggcagatgctgaccaggatacngctgaagacaggagaacaggacttccaaggggttc

SEQ ID NO: 49416 - DNA, 71 bp, chicken (Gallus Gallus)
  misc_feature (36): n=c or g
aggaggccttgctttgtatctacaaatagtggctgnttactcattgaatctcacctcagttgggacatgtt

SEQ ID NO: 49417 - DNA, 71 bp, chicken (Gallus Gallus)
  misc_feature (36): n=a or t
tgttcctccttaaccaaaaagaccttctaccatttngcgacttcatacctggaagtcattttttctgccca

SEQ ID NO: 49418 - DNA, 71 bp, chicken (Gallus Gallus)
  misc_feature (36): n=c or g
tctccttactcattagaatgagagaaataacatttncatttcagcatctaatcaccattccaatctactta

SEQ ID NO: 49419 - DNA, 71 bp, chicken (Gallus Gallus)
  misc_feature (36): n=a or t
acacaaacaaatgaaaatagccaacattttcccaanatccaggcccataggtttgcgcacagattttcttg

SEQ ID NO: 49420 - DNA, 71 bp, chicken (Gallus Gallus)
  misc_feature (36): n=c or g
gcttggctgactcagtgaattgggccttgaacttanaaagctaataaagctgtggcactttgtatacttgc

SEQ ID NO: 49421 - DNA, 71 bp, chicken (Gallus Gallus)
  misc_feature (36): n=c or g
tagcagagaaacagcatcctccccaaagctcctcangtgccagcaaagatgcacataacccacaatctatc

SEQ ID NO: 49422 - DNA, 71 bp, chicken (Gallus Gallus)
  misc_feature (36): n=a or t
cactcttcaactttccaatggattgacactgttctnaaggtaaattttgttacacgtgcaacttattagaa

SEQ ID NO: 49423 - DNA, 71 bp, chicken (Gallus Gallus)
  misc_feature (36): n=a or t
attgttctccctgatctattctgaatattacaaccnttagaacttccactggctctctggataaattactt

SEQ ID NO: 49424 - DNA, 71 bp, chicken (Gallus Gallus)
  misc_feature (36): n=c or g
atacttgccacactgagtttaataagtctaactcantagagttatcaatgacatcaagaaacagctcagtt

SEQ ID NO: 49425 - DNA, 71 bp, chicken (Gallus Gallus)
  misc_feature (36): n=a or t
cttccactcggtgtggccctgaatcagcacagtacncgagcacatgagcaatccactctaaatcagcagtg

SEQ ID NO: 49426 - DNA, 71 bp, chicken (Gallus Gallus)
  misc_feature (36): n=a or t
ttgaagacaaagattaaagagaagttaaaacaatantttttccttgtgaagttacattaaaggctacagta

SEQ ID NO: 49427 - DNA, 71 bp, chicken (Gallus Gallus)
  misc_feature (36): n=a or t
tggatatgaaaggagctcttaaccatttctttttanaaaacagtaaataaatgcactgttgacaatccatg

SEQ ID NO: 49428 - DNA, 71 bp, chicken (Gallus Gallus)
  misc_feature (36): n=c or g
tccgccggtgcgctctcaccccaacccgcccaccgngctctcagctgtgccgggattttaaatctcatttt

SEQ ID NO: 49429 - DNA, 71 bp, chicken (Gallus Gallus)
  misc_feature (36): n=c or g
gattctgactgctattttccttgagtgatttgaaantggcttaaagcagctacatctgctgttttctatcc

SEQ ID NO: 49430 - DNA, 71 bp, chicken (Gallus Gallus)
  misc_feature (36): n=c or g
ccagtccattatatagagaaatatatggatgtacanccccactcaacaggagtaattcctattagccaaag

SEQ ID NO: 49431 - DNA, 71 bp, chicken (Gallus Gallus)
  misc_feature (36): n=c or g
aaatgtctcagcccaatcagcaaattttagacactntgtgccttcagaatcatcaatttctctgctgcttt

SEQ ID NO: 49432 - DNA, 71 bp, chicken (Gallus Gallus)
  misc_feature (36): n=c or g
taacaactgtatttgagaagctctactgagcttcanttctactctaaatccacatttagtctttgccttct

SEQ ID NO: 49433 - DNA, 71 bp, chicken (Gallus Gallus)
  misc_feature (36): n=a or t
tcaggagtcacactgtaacttgggctagcaaaaganttttgcaaaaactggtatcaaatactactgctagg

SEQ ID NO: 49434 - DNA, 71 bp, chicken (Gallus Gallus)
  misc_feature (36): n=c or g
tacatatgcatgggtgcatatacttaaaatacattntgaccagtgatttttttcactagcgctctatgtga

SEQ ID NO: 49435 - DNA, 71 bp, chicken (Gallus Gallus)
  misc_feature (36): n=a or t
tctgaagtcgtaatgatgctctctgtagccttgaangttttgttactgtagatatcaagaatctgattctt

SEQ ID NO: 49436 - DNA, 71 bp, chicken (Gallus Gallus)
  misc_feature (36): n=a or t
ggtgacaacgcctgtttagtatgaagctcttctgcngtcacgctgcagtaaatggagactaaaagaagggg

SEQ ID NO: 49437 - DNA, 71 bp, chicken (Gallus Gallus)
  misc_feature (36): n=c or g
tacctcatatttaatagtttcaggcatttaaaacantagcttctttaatgcatctgtaattctagcgcact

SEQ ID NO: 49438 - DNA, 71 bp, chicken (Gallus Gallus)
  misc_feature (36): n=a or t
tgaatgatgcagggattatacagaaaaatatagtangcaatatgtcatcacacactgcaccataacgcaca

SEQ ID NO: 49439 - DNA, 71 bp, chicken (Gallus Gallus)
  misc_feature (36): n=a or t
cctccttaaagatatgccagctaatataatcagctntatatggttctggctaaacggttaaaaaaaaacgt

SEQ ID NO: 49440 - DNA, 71 bp, chicken (Gallus Gallus)
  misc_feature (36): n=c or g
ttgaaactgaaggttgtgagctcctctatttgcacntgaggtcagacttcctgatcactatggtcactgat

SEQ ID NO: 49441 - DNA, 71 bp, chicken (Gallus Gallus)
  misc_feature (36): n=c or g
gctcttgcttagcttcttagttccaacctgtaccantgccttaatatttgaatattaacaatattgatgat

SEQ ID NO: 49442 - DNA, 71 bp, chicken (Gallus Gallus)
  misc_feature (36): n=c or g
tacaaggcagtttggactcgtcactcacagcactgnaggaattgtctctgtaacactacagggctgaaaaa

SEQ ID NO: 49443 - DNA, 71 bp, chicken (Gallus Gallus)
  misc_feature (36): n=a or t
ttctaggaaaatgctagttaaaaaaatcagtgtatnttgccagtccttcatcaggtaaacagggatcaaga

SEQ ID NO: 49444 - DNA, 71 bp, chicken (Gallus Gallus)
  misc_feature (36): n=c or g
ctgaattttcagtaatatagcaaactgtatctattntgagagttatattgtctgttgtaagttctccaatc

SEQ ID NO: 49445 - DNA, 71 bp, chicken (Gallus Gallus)
  misc_feature (36): n=a or t
agaaaatgaaatggtagtctaagcacactgagaacntagcatggctggatgtacggatgctgtgggtcact

SEQ ID NO: 49446 - DNA, 71 bp, chicken (Gallus Gallus)
  misc_feature (36): n=c or g
ttgggtatgttatgaaacacagctccactgcaaggnaatcttccccagttcatctgctgtggctgctcaga

SEQ ID NO: 49447 - DNA, 71 bp, chicken (Gallus Gallus)
  misc_feature (36): n=c or g
caaatgatgtggggcctgggcagagctccaggactnagaagagcaacacatggagtatattgcatccctaa

SEQ ID NO: 49448 - DNA, 71 bp, chicken (Gallus Gallus)
  misc_feature (36): n=a or t
tggaaataaaatctaagttcccttaattgcacaacnaatctatggacagcatttcagattttgtcttcctg

SEQ ID NO: 49449 - DNA, 71 bp, chicken (Gallus Gallus)
  misc_feature (36): n=a or t
agaaaaaaacgaatgtgtaagtcagttcctagcacnaagttgctattcttctaccctgtcagaaattgatg

SEQ ID NO: 49450 - DNA, 71 bp, chicken (Gallus Gallus)
  misc_feature (36): n=a or t
agtgaatgcagataaatgctgcagttaaaaatcacngttggtgaacacaatcatggcatgttcttgtagcc

SEQ ID NO: 49451 - DNA, 71 bp, chicken (Gallus Gallus)
  misc_feature (36): n=c or g
gggggtataaaatcaacccaatgggacaggaggggntcaccatgaggccatgggggttttgtggggtaaat

SEQ ID NO: 49452 - DNA, 71 bp, chicken (Gallus Gallus)
  misc_feature (36): n=c or g
tgtatctgctatcttagctcgctgggcttcaggcantgttgtgtttgataatctgaactcgcctacttgcc

SEQ ID NO: 49453 - DNA, 71 bp, chicken (Gallus Gallus)
  misc_feature (36): n=c or g
tttctaaagcagctgtaaatatggctcttcttcctnatttctggctataggagtacttcaattagagatgg

SEQ ID NO: 49454 - DNA, 71 bp, chicken (Gallus Gallus)
  misc_feature (36): n=a or t
gcatcatgcctggtatgagaaaaagttctgaggtgntgaaataccaggaaagacacagaagcattcaaatt

SEQ ID NO: 49455 - DNA, 71 bp, chicken (Gallus Gallus)
  misc_feature (36): n=a or t
tagatggtctggggttttgaagctcttttctaatanccacttatacacagattcgtagaaacatagaatca

SEQ ID NO: 49456 - DNA, 71 bp, chicken (Gallus Gallus)
  misc_feature (36): n=c or g
gaatatgggacaatgcctttctaatacagctgcttncaattaactgctcctgcaatttctcctttagacca

SEQ ID NO: 49457 - DNA, 71 bp, chicken (Gallus Gallus)
  misc_feature (36): n=c or g
gtcctgaatgtattcagtgtcaaggtagccaatctncccagatatgccatctaggcaaggacataaatgct

SEQ ID NO: 49458 - DNA, 71 bp, chicken (Gallus Gallus)
  misc_feature (36): n=c or g
cgtatatatctacatttccacaaacagtgcatcatntaaaggtacacagcccgactttcagatatcatcta

SEQ ID NO: 49459 - DNA, 71 bp, chicken (Gallus Gallus)
  misc_feature (36): n=a or t
gtgactaaaggggagggtcacatggataagtgtatntaacactgcttcctatgctgtaaataatcaagtgt

SEQ ID NO: 49460 - DNA, 71 bp, chicken (Gallus Gallus)
  misc_feature (36): n=c or g
ggggagttcttctgtgtggtgagccccatggatgcntgttggccttatgaacccctggcaagggtcctgag

SEQ ID NO: 49461 - DNA, 71 bp, chicken (Gallus Gallus)
  misc_feature (36): n=c or g
caacagagcaaacgtataaacagtgaagtgatgtantccttccaaagaaatatgaaaaggataacttcaca

SEQ ID NO: 49462 - DNA, 71 bp, chicken (Gallus Gallus)
  misc_feature (36): n=a or t
tccaaaacttctaccaattggagaaagaaaaaaaanagactgtaatgggattttgatatgttctcctcaag

SEQ ID NO: 49463 - DNA, 71 bp, chicken (Gallus Gallus)
  misc_feature (36): n=c or g
gtgattagtatcatgtcttataatcacatctgtttntatgtccctgtttgtgcttctacctctgcctttct

SEQ ID NO: 49464 - DNA, 71 bp, chicken (Gallus Gallus)
  misc_feature (36): n=a or t
tctgctggtttaattggattgtggtatatttgtgtngatggctgaagtcttccaggccactgttttccaga

SEQ ID NO: 49465 - DNA, 71 bp, chicken (Gallus Gallus)
  misc_feature (36): n=c or g
tcccagtctgaatttcagcagggcggtgagatactnctgggcctgcagggctcactgtgtgaaatacctgg

SEQ ID NO: 49466 - DNA, 71 bp, chicken (Gallus Gallus)
  misc_feature (36): n=a or t
aagttacagagttgtattgtccagttacctataaanacaaatgaactcctttaagtctgaatgtttcaaaa

SEQ ID NO: 49467 - DNA, 71 bp, chicken (Gallus Gallus)
  misc_feature (36): n=c or g
cacaaaaatttctaattgtaacacccatgcaagtgnttgtctatactgccttcccttttcacaagtgataa

SEQ ID NO: 49468 - DNA, 71 bp, chicken (Gallus Gallus)
  misc_feature (36): n=c or g
cttatctccttaccatttcttaccatttccttctgnttattaatcacatttcctggtcaacaaaatggctg

SEQ ID NO: 49469 - DNA, 71 bp, chicken (Gallus Gallus)
  misc_feature (36): n=a or t
cagattgcatgcctcatcgtgcacattcctcttganactttcagtagcagtgcccaacctgtttctcatga

SEQ ID NO: 49470 - DNA, 71 bp, chicken (Gallus Gallus)
  misc_feature (36): n=a or t
tgcctaaaaagcaagtgaaatcattggtgatggctnaaaaaatggggcaaatgcactctggagcatttgca

SEQ ID NO: 49471 - DNA, 71 bp, chicken (Gallus Gallus)
  misc_feature (36): n=a or t
aaatgtcccaaaagactgtaggcatgtgtatgtttnaaaacgttgtacagtactgatggtaaccgtatgat

SEQ ID NO: 49472 - DNA, 71 bp, chicken (Gallus Gallus)
  misc_feature (36): n=a or t
ggagctcagcccatgctgctgggaccccagtaattnaagaattttaaaaacacacatagtaaataatcaga

SEQ ID NO: 49473 - DNA, 71 bp, chicken (Gallus Gallus)
  misc_feature (36): n=c or g
aggcccaaagtataagcaaactatgaaagccattangcagattcatggatgaaaggtcagttaagggcagc

SEQ ID NO: 49474 - DNA, 71 bp, chicken (Gallus Gallus)
  misc_feature (36): n=c or g
catccttatatatctccagaagaatgtatacacctnctttcatacattggcatacatttaatgtagactga

SEQ ID NO: 49475 - DNA, 71 bp, chicken (Gallus Gallus)
  misc_feature (36): n=c or g
ggcagatgggttcagatggcttcacagaacatctgnatgaaccacccagcagtgttccagtctccagttta

SEQ ID NO: 49476 - DNA, 71 bp, chicken (Gallus Gallus)
  misc_feature (36): n=a or t
ctaaacctatgttcatttctaagggggacaagatanaggaagagtgcagacacatctctttactgttgcct

SEQ ID NO: 49477 - DNA, 71 bp, chicken (Gallus Gallus)
  misc_feature (36): n=a or t
tcctccattccctggctgcagcaggcctgtgcatgnctctataagctattaacaacaataacactaatcct

SEQ ID NO: 49478 - DNA, 71 bp, chicken (Gallus Gallus)
  misc_feature (36): n=c or g
tcatgtaaggatatagacttaaacttgaggtcttgnaaaaaacttctctctttctcgtgtcttcatttaac

SEQ ID NO: 49479 - DNA, 71 bp, chicken (Gallus Gallus)
  misc_feature (36): n=a or t
tgcacagaaatcctggaaatggggttttggcagtantgtggcctttgatttttttcaccaggtctctctct

SEQ ID NO: 49480 - DNA, 71 bp, chicken (Gallus Gallus)
  misc_feature (36): n=c or g
ggggttgctatagaaacagacccacttgcaatgatncagcctctttcggaagcgctgcatcaccgcctgcc

SEQ ID NO: 49481 - DNA, 71 bp, chicken (Gallus Gallus)
  misc_feature (36): n=c or g
agtaggaattctgcatccaaattgagcttgagtcanaaagggtttcctttagcagtgcaggaatgcagtac

SEQ ID NO: 49482 - DNA, 71 bp, chicken (Gallus Gallus)
  misc_feature (36): n=a or t
agcttttacaaccacagagagagagcttccaggtcnatgtcatatacacacaacaacttcaaccctaaatt

SEQ ID NO: 49483 - DNA, 71 bp, chicken (Gallus Gallus)
  misc_feature (36): n=c or g
ggaacacttgttcctgtccgttcatgagggatgccnccatgtagcaggaggacttgtgccaacgtcatcaa

SEQ ID NO: 49484 - DNA, 71 bp, chicken (Gallus Gallus)
  misc_feature (36): n=a or t
ctctgaatgcatacatggaatattaatggttaaaangcgtatatgctttttttattactagggtttcttta

SEQ ID NO: 49485 - DNA, 71 bp, chicken (Gallus Gallus)
  misc_feature (36): n=c or g
atgagctatgaaggcatgctacgtatggagctaganacaaaacacgtttgcccagagagcaacagcaggga

SEQ ID NO: 49486 - DNA, 71 bp, chicken (Gallus Gallus)
  misc_feature (36): n=a or t
ttgagacgcagaagcacagtggacaaagaagcatantgatattgcatgtcacattgtctttttcctaataa

SEQ ID NO: 49487 - DNA, 71 bp, chicken (Gallus Gallus)
  misc_feature (36): n=c or g
cactgtgtggattgctgggagtctgtgacctcccanccagagaagccctcaggcaaacacaggcgtatgtg

SEQ ID NO: 49488 - DNA, 71 bp, chicken (Gallus Gallus)
  misc_feature (36): n=a or t
agaataaattcctgttgtttgtgaggaactagatangtctctagctaattaatgcacttagtatgtatccc

SEQ ID NO: 49489 - DNA, 71 bp, chicken (Gallus Gallus)
  misc_feature (36): n=a or t
tattgataagacttaacatacaacagaaaattgcantttctggccaacagcaaattctaaaatacaacgta

SEQ ID NO: 49490 - DNA, 71 bp, chicken (Gallus Gallus)
  misc_feature (36): n=c or g
ctctccagttaaccatagcctgggtaagctgaaaanactttcaaatgttctagtgtgcgtgatgactcctc

SEQ ID NO: 49491 - DNA, 71 bp, chicken (Gallus Gallus)
  misc_feature (36): n=a or t
tgtggtacaaacaattaaacaactcttgtaggtttnagttctacagtttctgtcatattactccccacaat

SEQ ID NO: 49492 - DNA, 71 bp, chicken (Gallus Gallus)
  misc_feature (36): n=c or g
gctaatatgctatcaggagacacattcagtgagaancaaccaccacagtgcacccatgcaatgttttatac

SEQ ID NO: 49493 - DNA, 71 bp, chicken (Gallus Gallus)
  misc_feature (36): n=a or t
cttaatgtagggcttgccacatcctcgaaaggttanaggtcaacattctccatactaaaggaagtgtgact

SEQ ID NO: 49494 - DNA, 71 bp, chicken (Gallus Gallus)
  misc_feature (36): n=c or g
tcagctaccttaatgcaaacaagctactgcatttgnagtgtattaaccattagtgttctcaaaaaacctta

SEQ ID NO: 49495 - DNA, 71 bp, chicken (Gallus Gallus)
  misc_feature (36): n=c or g
atgggtataagggaagtcataaatgcacatctgganagggaaatagtgtcttggagaggggcttgtctgct

SEQ ID NO: 49496 - DNA, 71 bp, chicken (Gallus Gallus)
  misc_feature (36): n=c or g
cagagatctggaacagattacctgaagtcgctatgnaatttccattagctgaagcttctgatgtaagtgaa

SEQ ID NO: 49497 - DNA, 71 bp, chicken (Gallus Gallus)
  misc_feature (36): n=a or t
tcagagaacagagccaaacaaccctaaggatcttanatacacagcaatattttccttaagaggagcattac

SEQ ID NO: 49498 - DNA, 71 bp, chicken (Gallus Gallus)
  misc_feature (36): n=a or t
caactcaccttttgcatcagattgggaacgaggatnaataaagaaacaacccctcagcactcctttctgaa

SEQ ID NO: 49499 - DNA, 71 bp, chicken (Gallus Gallus)
  misc_feature (36): n=c or g
gcacaagacaaacagacgcacacaccaatcgctctntgctggctcctcctcttttcccagaagcagaaggc

SEQ ID NO: 49500 - DNA, 71 bp, chicken (Gallus Gallus)
  misc_feature (36): n=a or t
aaaaagatttgctactaaatttgaactgcctttccngggaaattcacaggaatcagtgtgctatgatatta

SEQ ID NO: 49501 - DNA, 71 bp, chicken (Gallus Gallus)
  misc_feature (36): n=a or t
tattacctacataattggatggcagcatttagcagngattaattgaaacttaacatgcgtttggggattaa

SEQ ID NO: 49502 - DNA, 71 bp, chicken (Gallus Gallus)
  misc_feature (36): n=c or g
tttagatattttcttttacagtacaactaaagagcnagtgagtatctatgtatgctttttttcactcctgt

SEQ ID NO: 49503 - DNA, 71 bp, chicken (Gallus Gallus)
  misc_feature (36): n=c or g
gaaagactaaaatcctggatgttatacaggcaaaantgtagtgacctctgggaagtgaaatatagttgctt

SEQ ID NO: 49504 - DNA, 71 bp, chicken (Gallus Gallus)
  misc_feature (36): n=c or g
agagttgatgatggcgctgtgtattcttgaagggangctttttttcacatataattgtacaatacagaaag

SEQ ID NO: 49505 - DNA, 71 bp, chicken (Gallus Gallus)
  misc_feature (36): n=c or g
aaaggcactggagccagcatgggaaggtgcaggcanctcttgctcctgtgcccaatggctaactaagcagg

SEQ ID NO: 49506 - DNA, 71 bp, chicken (Gallus Gallus)
  misc_feature (36): n=c or g
atcagtgagcagagcggaggggcccagatcctgtantgaactttgatgatacttactgcaagtgctgttga

SEQ ID NO: 49507 - DNA, 71 bp, chicken (Gallus Gallus)
  misc_feature (36): n=a or t
ttcacaaagggcctctgcagccctctttgcatcttnagcgagcgccctaaatccacccagccaagtgttgg

SEQ ID NO: 49508 - DNA, 71 bp, chicken (Gallus Gallus)
  misc_feature (36): n=c or g
tctgtttctagttgagcttgtattgtttggaactgntaatgtagaattattgaaaaaattacgtttcatgt

SEQ ID NO: 49509 - DNA, 71 bp, chicken (Gallus Gallus)
  misc_feature (36): n=c or g
ggaaatgggcatcctcctgatcacgtcctgctctangagagtcctaaggaagtctcaatccctttttgctg

SEQ ID NO: 49510 - DNA, 71 bp, chicken (Gallus Gallus)
  misc_feature (36): n=c or g
tgcagagtctgactgcagaatgaggcgaattggaanttctggaaatacatcagttatgctacccgctggcc

SEQ ID NO: 49511 - DNA, 71 bp, chicken (Gallus Gallus)
  misc_feature (36): n=a or t
ctcccttcaactctgtgaattagttggagattgttnttataagagtttcctatacattgtatttccatgtc

SEQ ID NO: 49512 - DNA, 71 bp, chicken (Gallus Gallus)
  misc_feature (36): n=c or g
tagtgtatcagaaaatactactgtctaaataaaganatgtacaaagactaaaaggtattgcagttaaactt

SEQ ID NO: 49513 - DNA, 71 bp, chicken (Gallus Gallus)
  misc_feature (36): n=a or t
gtcgcgtggtgtccaacaagaactgggctgttagcnactttaacaagggacagtaatatcattaggctgta

SEQ ID NO: 49514 - DNA, 71 bp, chicken (Gallus Gallus)
  misc_feature (36): n=c or g
gaagatcaagaagcaatcagattcctttccaaggangagatactttatagcaataagttcttaaactgaac

SEQ ID NO: 49515 - DNA, 71 bp, chicken (Gallus Gallus)
  misc_feature (36): n=c or g
ttatattctagaattctttatattaacgtcagccanaagaacaaggttaagtccctctcaagcaaagaaat

SEQ ID NO: 49516 - DNA, 71 bp, chicken (Gallus Gallus)
  misc_feature (36): n=c or g
ctgtatatttgcatctcctgcatgagctggatttantttttgttcctcagacaaaggagatagttgcgttg

SEQ ID NO: 49517 - DNA, 71 bp, chicken (Gallus Gallus)
  misc_feature (36): n=c or g
ttcagagataggcaaggaaagatgtcagtgacgttnttgctgttatcttcacataatgggaggctgggcag

SEQ ID NO: 49518 - DNA, 71 bp, chicken (Gallus Gallus)
  misc_feature (36): n=c or g
gctgtccgaaccatcacacctatcccctaaattacncagcgcttcttctggctcctagctgaagatgaagt

SEQ ID NO: 49519 - DNA, 71 bp, chicken (Gallus Gallus)
  misc_feature (36): n=a or t
agttctcataacacagacccacatctttcttttccngtagagagcatatgttttcttctctctactatttt

SEQ ID NO: 49520 - DNA, 71 bp, chicken (Gallus Gallus)
  misc_feature (36): n=a or t
gttctctggtggaattcttccagattgccagggtcnaaaaagtcaggctggctgctgagggcggcacaggt

SEQ ID NO: 49521 - DNA, 71 bp, chicken (Gallus Gallus)
  misc_feature (36): n=c or g
cagtgcacagtttagaattgccttataatgtctcanttaacaatttttgtatctgagctcttgaatttcag

SEQ ID NO: 49522 - DNA, 71 bp, chicken (Gallus Gallus)
  misc_feature (36): n=a or t
ctttctgaatgtcaatcaacatgtagttagtctctncactgaagaaattgtaactaggtttttagtggtga

SEQ ID NO: 49523 - DNA, 71 bp, chicken (Gallus Gallus)
  misc_feature (36): n=a or t
ctccttaaatgttctgtatgttccacaaatctttangatctgtgtgactacaggcctgaaaacctcagcct

SEQ ID NO: 49524 - DNA, 71 bp, chicken (Gallus Gallus)
  misc_feature (36): n=c or g
atttgtcagaatgctatacaggtcagaaatttaaantgatgtataatgaaattgacatcgactttgataat

SEQ ID NO: 49525 - DNA, 71 bp, chicken (Gallus Gallus)
  misc_feature (36): n=a or t
tgtttctagacatgatgaatgtggccaggttttccngtctttcccccgcactcaacgtcatgagcctcctg

SEQ ID NO: 49526 - DNA, 71 bp, chicken (Gallus Gallus)
  misc_feature (36): n=a or t
aaagcagcaatatcaaattcttggaaactcatcaanttgtataatatggtctagcttaatactgcaaattc

SEQ ID NO: 49527 - DNA, 71 bp, chicken (Gallus Gallus)
  misc_feature (36): n=a or t
actatttaaaatatgattatctaagtcagtagcaantccacattaatatttaaggtgtcaagatactgctc

SEQ ID NO: 49528 - DNA, 71 bp, chicken (Gallus Gallus)
  misc_feature (36): n=a or t
cacatcaaggttatctttcaagcaagtagctggaantttcattcagattctgatgcttggggtagctacac

SEQ ID NO: 49529 - DNA, 71 bp, chicken (Gallus Gallus)
  misc_feature (36): n=a or t
tcgtaatctagacgtatacgatgcttcccaagattnttttttaagcctcatttatttggaatagctaggca

SEQ ID NO: 49530 - DNA, 71 bp, chicken (Gallus Gallus)
  misc_feature (36): n=c or g
aggagagtgcatggcaccactgagtacaattccagncagagcacaatgctcaggaacagaaacactaagag

SEQ ID NO: 49531 - DNA, 71 bp, chicken (Gallus Gallus)
  misc_feature (36): n=c or g
acaccaggatattaaacagtagaacagattgaacantagattgcatctagtggtgtgtgtacacctaactt

SEQ ID NO: 49532 - DNA, 71 bp, chicken (Gallus Gallus)
  misc_feature (36): n=a or t
caggagaaaatagccagaatagatctctgagctgcngtagttagatgatttctggtacttgcaatggcttg

SEQ ID NO: 49533 - DNA, 71 bp, chicken (Gallus Gallus)
  misc_feature (36): n=c or g
acatgactttcacctaggattgccatctctgtgaanttgtcagcaacatgtaagaccgaagcaacagtagt

SEQ ID NO: 49534 - DNA, 71 bp, chicken (Gallus Gallus)
  misc_feature (36): n=a or t
ttgctgaaaataatctcctttacttcaatatgaaantttgaaaaaatagtcaggatttgttacaagacaaa

SEQ ID NO: 49535 - DNA, 71 bp, chicken (Gallus Gallus)
  misc_feature (36): n=c or g
cttgactttagtacctgttatcaaactaacctcagnatacgttttaaaacgcttgtgacattttaaatggg

SEQ ID NO: 49536 - DNA, 71 bp, chicken (Gallus Gallus)
  misc_feature (36): n=c or g
gcagcacttccagatttgaagcctcctacttgtcantcaagaacttaaattagcaaacagacagggataca

SEQ ID NO: 49537 - DNA, 71 bp, chicken (Gallus Gallus)
  misc_feature (36): n=c or g
agttgtttttttcttcctggtgccacttttccagancgattcctgatttaaaaaccaaacgccaaatgcag

SEQ ID NO: 49538 - DNA, 71 bp, chicken (Gallus Gallus)
  misc_feature (36): n=a or t
tcaccagtctaaccagcatgaagaacagtgagaatncaggtttgcaccttgatgcaaaagttttcatcctt

SEQ ID NO: 49539 - DNA, 71 bp, chicken (Gallus Gallus)
  misc_feature (36): n=c or g
agcgatacttctgggacgttctggggctgttcagtnctgaaggctttggcagacgcttgtctttccttctg

SEQ ID NO: 49540 - DNA, 71 bp, chicken (Gallus Gallus)
  misc_feature (36): n=a or t
cttattaatatatcaacttactatttacttattaanatatcaacttgtggcacacagctcatgctcttcaa

SEQ ID NO: 49541 - DNA, 71 bp, chicken (Gallus Gallus)
  misc_feature (36): n=a or t
ctatccgcgtttccacagatctcaactaaagacatnatagctgtatttgtcaaaataaacatttcagtgtt

SEQ ID NO: 49542 - DNA, 71 bp, chicken (Gallus Gallus)
  misc_feature (36): n=a or t
ttgtgtatttcatattggtctccgtaccatcagtcntaattaattgctacaagtttgctgtagttaacatg

SEQ ID NO: 49543 - DNA, 71 bp, chicken (Gallus Gallus)
  misc_feature (36): n=a or t
gtggctacaagtgctgccaggttataaaggacacgnacagaatgacttcagattacaaactgccatcttta

SEQ ID NO: 49544 - DNA, 71 bp, chicken (Gallus Gallus)
  misc_feature (36): n=c or g
gtggggaaaatgaaatctgagtgttacaatcagtanggcagcagaatagctggggctgtactgtctcctgg

SEQ ID NO: 49545 - DNA, 71 bp, chicken (Gallus Gallus)
  misc_feature (36): n=c or g
ctataattctatgattcaattgggcctgcttctcgnctcttgcctggccttctctcgtgggaattatgtca

SEQ ID NO: 49546 - DNA, 71 bp, chicken (Gallus Gallus)
  misc_feature (36): n=c or g
gttagacagtctgtgtttctgtctcagactcctcantctgagcttctgtgagcaacctcaaacagggatag

SEQ ID NO: 49547 - DNA, 71 bp, chicken (Gallus Gallus)
  misc_feature (36): n=c or g
ggaatgctgtggagtaccttttagactggccatatntctcaagagagaaataaacttgtagacatgtagaa

SEQ ID NO: 49548 - DNA, 71 bp, chicken (Gallus Gallus)
  misc_feature (36): n=a or t
tgtggcaccccctgccttgatagaggattatgtcangacatatgggtacacacccttaattcatggcttcc

SEQ ID NO: 49549 - DNA, 71 bp, chicken (Gallus Gallus)
  misc_feature (36): n=c or g
tcagagaggcagagaaggtaaatggctcattgtctnggacaggctcagcttttcttatgtctcctgatgac

SEQ ID NO: 49550 - DNA, 71 bp, chicken (Gallus Gallus)
  misc_feature (36): n=c or g
aactgtggctcttatagcactgaggatgaagagctntgtggttctttgaaatctaaatatgttctgtgcaa

SEQ ID NO: 49551 - DNA, 71 bp, chicken (Gallus Gallus)
  misc_feature (36): n=a or t
ggtgaaattcttcgaagtagttttgttgaaggttcnttttgttggcaataggaagaatgaaagaaattttc

SEQ ID NO: 49552 - DNA, 71 bp, chicken (Gallus Gallus)
  misc_feature (36): n=c or g
gcccagcagggccgcatgctgtgggtgtttggagcncatctgtttgcccagagatcccctagagaacaggc

SEQ ID NO: 49553 - DNA, 71 bp, chicken (Gallus Gallus)
  misc_feature (36): n=a or t
catcataagcacttcctcacgaagaatcttttaatngatttaactgatctgcctttattaaaatatctcag

SEQ ID NO: 49554 - DNA, 71 bp, chicken (Gallus Gallus)
  misc_feature (36): n=c or g
atataaacaactattccagaaacttttttggagtgnattctggataacctggcaccatttagagcattaag

SEQ ID NO: 49555 - DNA, 71 bp, chicken (Gallus Gallus)
  misc_feature (36): n=c or g
gtatcagcactgacctctgtggctctgtcccagatntgccaagaatacctgtggggtgtgggaggcagagg

SEQ ID NO: 49556 - DNA, 71 bp, chicken (Gallus Gallus)
  misc_feature (36): n=c or g
tggtcaagctgtttcctcaaactcttttgttccctnttcttcctgtgtgtgtgaggtaatcagaagtctca

SEQ ID NO: 49557 - DNA, 71 bp, chicken (Gallus Gallus)
  misc_feature (36): n=c or g
ttgttcttgctttaagtatcttccaattttgtaaanctgtcctgcctttcaacccttcaggaactgaaact

SEQ ID NO: 49558 - DNA, 71 bp, chicken (Gallus Gallus)
  misc_feature (36): n=c or g
agaattttatacagtcataacttgtcagcaacgtgntgagtggtagcattaatttaatgagaaattgggac

SEQ ID NO: 49559 - DNA, 71 bp, chicken (Gallus Gallus)
  misc_feature (36): n=a or t
aggcctgtggaaatggatcactgttacaaagctgtnagaaagccattatggtggactttcttataaagctg

SEQ ID NO: 49560 - DNA, 71 bp, chicken (Gallus Gallus)
  misc_feature (36): n=c or g
catttgttgatggtttgatcatcttccagatatttncttcctcttcttatccctcagacaacctatttttt

SEQ ID NO: 49561 - DNA, 71 bp, chicken (Gallus Gallus)
  misc_feature (36): n=c or g
aattgcacagcctgcaaactgtagcaagggcaaggngcagctcgcagaggtagtgatgcaacaaacagcta

SEQ ID NO: 49562 - DNA, 71 bp, chicken (Gallus Gallus)
  misc_feature (36): n=c or g
cagcagctcagagattcaatgctcacattacttaanagttaatttaaaaccctacaaaaccaactgtctca

SEQ ID NO: 49563 - DNA, 71 bp, chicken (Gallus Gallus)
  misc_feature (36): n=c or g
gccagtaaaccgcaaactggatgatagaaaggaaantggaatgtaagttgtaaatagcattattgactaaa

SEQ ID NO: 49564 - DNA, 71 bp, chicken (Gallus Gallus)
  misc_feature (36): n=a or t
ggttttctgacatctggtctctctaccctttttttnattattctttttctaaccacagcatttttctaagc

SEQ ID NO: 49565 - DNA, 71 bp, chicken (Gallus Gallus)
  misc_feature (36): n=a or t
tttgggtacaaacccctgcagacaacaactctgttntatcttggcttcttgcatttgtttggacttctccc

SEQ ID NO: 49566 - DNA, 71 bp, chicken (Gallus Gallus)
  misc_feature (36): n=a or t
agttcttgttacactatatagctgaacatgagaaantgccctagttaacaacaaacatgtaagatttagat

SEQ ID NO: 49567 - DNA, 71 bp, chicken (Gallus Gallus)
  misc_feature (36): n=a or t
gtggaaactagaaagactgcatttgatacacattcnggtaggaaggacggctgggaaggatattctgctcg

SEQ ID NO: 49568 - DNA, 71 bp, chicken (Gallus Gallus)
  misc_feature (36): n=c or g
tgggcagagcatgaaaataagaaaggcaagattttnagaagcttcatggcttgagataaaaatggtgtaat

SEQ ID NO: 49569 - DNA, 71 bp, chicken (Gallus Gallus)
  misc_feature (36): n=c or g
ccggggcaaggacagacatcagaccaaattatggangagagcttctgcagtgaaactcccatgagaaagaa

SEQ ID NO: 49570 - DNA, 71 bp, chicken (Gallus Gallus)
  misc_feature (36): n=c or g
gctgaataggaagaaaaaagtagtctcctactccanctcaaaataagccctccaacatgactggcactata

SEQ ID NO: 49571 - DNA, 71 bp, chicken (Gallus Gallus)
  misc_feature (36): n=a or t
ttttgagttaggccatcacttcagttaacttcagcntgctgctgagaacaagctaagcatgaaagatctat

SEQ ID NO: 49572 - DNA, 71 bp, chicken (Gallus Gallus)
  misc_feature (36): n=a or t
tatgagtcaatttctgataattaactatgactatgntttagtagcttttgggaatcatacccacaaatact

SEQ ID NO: 49573 - DNA, 71 bp, chicken (Gallus Gallus)
  misc_feature (36): n=a or t
gacatttccttaggaatatttatgaatactgacttngcaaaatttaaagggaagcagtccagattcctggg

SEQ ID NO: 49574 - DNA, 71 bp, chicken (Gallus Gallus)
  misc_feature (36): n=a or t
tcagttcctggtatgtatttttagaaaactagagcntattttgtgggcactgtgatatattcctgctgctg

SEQ ID NO: 49575 - DNA, 71 bp, chicken (Gallus Gallus)
  misc_feature (36): n=a or t
tttgtttcgccacccataaaatcctacctagacatntttttcttgtacatttttactcctgtttggtgcgg

SEQ ID NO: 49576 - DNA, 71 bp, chicken (Gallus Gallus)
  misc_feature (36): n=c or g
tctttttaatcttccaaatgcttcagctacagtgantgaaattcttgaagagctgaacactcttgtccaaa

SEQ ID NO: 49577 - DNA, 71 bp, chicken (Gallus Gallus)
  misc_feature (36): n=a or t
acacagcaggattagaagatcacaaacctttctgcnatctgtggatgctgctagacagtctacctgactta

SEQ ID NO: 49578 - DNA, 71 bp, chicken (Gallus Gallus)
  misc_feature (36): n=c or g
attcagttcttactccacagagcataattgtcaaanctctctgcagtgaatgagtttacaccaccaggaag

SEQ ID NO: 49579 - DNA, 71 bp, chicken (Gallus Gallus)
  misc_feature (36): n=a or t
ggaaataaaaagcagttgcccatcagcagccacctnaatgccttggcaggcagtgtccttaaatattcact

SEQ ID NO: 49580 - DNA, 71 bp, chicken (Gallus Gallus)
  misc_feature (36): n=c or g
tgcttgacacagtgtgtcaaatgcaaaaagcctttntgaggtcaggaggccttcattgctggtgtctggaa

SEQ ID NO: 49581 - DNA, 71 bp, chicken (Gallus Gallus)
  misc_feature (36): n=c or g
agtgatttttaagggacatgagtcaagaggagctgnctaatgccaaccaactgcttctgctgggtacgtac

SEQ ID NO: 49582 - DNA, 71 bp, chicken (Gallus Gallus)
  misc_feature (36): n=c or g
ttcccacggtaacatccagagggaacacatagtccnccagagagagtacagcagcacaatgcaagcggctc

SEQ ID NO: 49583 - DNA, 71 bp, chicken (Gallus Gallus)
  misc_feature (36): n=c or g
aaatagcagtgtaattttgggttgctgcaacaggancttgagtggagagatgatcgttgctggggaagcat

SEQ ID NO: 49584 - DNA, 71 bp, chicken (Gallus Gallus)
  misc_feature (36): n=c or g
gcaagatacttttccacgcaacatgcattttgactngtgttacaaaggtagaggggattgggcttgtatat

SEQ ID NO: 49585 - DNA, 71 bp, chicken (Gallus Gallus)
  misc_feature (36): n=a or t
aattgtaacaagtatgggaaatgacagcaccctccnttggaaggatttatctccataattacaatcatatg

SEQ ID NO: 49586 - DNA, 71 bp, chicken (Gallus Gallus)
  misc_feature (36): n=a or t
ttcatgctaatgtgcaaaccatgagaccataatgcntgtctaactgctattgttaagaactcaaggaagaa

SEQ ID NO: 49587 - DNA, 71 bp, chicken (Gallus Gallus)
  misc_feature (36): n=c or g
gtccttaatcaaatgattccccttttaacaagcagntgttgctttccttacaggtgatagcttttgcctcg

SEQ ID NO: 49588 - DNA, 71 bp, chicken (Gallus Gallus)
  misc_feature (36): n=c or g
tcatttatcaaggtagggtttttttagatacttcanaaaacttatttttgccatcaaattcaaactcaacc

SEQ ID NO: 49589 - DNA, 71 bp, chicken (Gallus Gallus)
  misc_feature (36): n=a or t
aggatttaaattgtagtttattaaagttgttatcanagccttcagttggtaatacatatgtaactgcaatg

SEQ ID NO: 49590 - DNA, 71 bp, chicken (Gallus Gallus)
  misc_feature (36): n=a or t
ttaatctctgtacaggacatgtaagaaataacatcnctaatactcaactcccctcctctttctgaaatcat

SEQ ID NO: 49591 - DNA, 71 bp, chicken (Gallus Gallus)
  misc_feature (36): n=c or g
ggcagtactctgaaggagtaattcagtttcacacanattgcagtacttacagtaaggatgaggagctgaga

SEQ ID NO: 49592 - DNA, 71 bp, chicken (Gallus Gallus)
  misc_feature (36): n=a or t
ccaaacagattatccagtataagttgaatgtgattncaacaaacctttggtgactaaaaacaccacatgga

SEQ ID NO: 49593 - DNA, 71 bp, chicken (Gallus Gallus)
  misc_feature (36): n=a or t
cactatcagtaccactgctttacattaagatctgtnattagcatcacaaatattatatcatttaggtcagc

SEQ ID NO: 49594 - DNA, 71 bp, chicken (Gallus Gallus)
  misc_feature (36): n=a or t
ttctaactgaatctgcctgttcctatgttggtagangcaggatatctcgttggaactgataagcatgtgag

SEQ ID NO: 49595 - DNA, 71 bp, chicken (Gallus Gallus)
  misc_feature (36): n=a or t
catagaaaacctttctctaaagacttgtctaggttntgaatgtgctactgttactttctcacttttttatc

SEQ ID NO: 49596 - DNA, 71 bp, chicken (Gallus Gallus)
  misc_feature (36): n=a or t
aatgtgctgttccacctgttagtcttctgacttcangttttgtttgatgtgccttagctttcctgagtgtg

SEQ ID NO: 49597 - DNA, 71 bp, chicken (Gallus Gallus)
  misc_feature (36): n=c or g
accaggagctttacccggtgctttcagcttacgtgnctttgctaagcctcctgatggccgcccatttaaca

SEQ ID NO: 49598 - DNA, 71 bp, chicken (Gallus Gallus)
  misc_feature (36): n=c or g
tggatataagactaccaacaatttccagaaaggttntctgtgtttctgttgtctggatgttaattaaactg

SEQ ID NO: 49599 - DNA, 71 bp, chicken (Gallus Gallus)
  misc_feature (36): n=a or t
tttgtctcagtagtcatagaattacttctccttaanatctatctacaaaagaagcttgaaagcccgtttga

SEQ ID NO: 49600 - DNA, 71 bp, chicken (Gallus Gallus)
  misc_feature (36): n=a or t
tcattctgacaatgattgaacatctacttctaacancattattattgaaatcatgttgacaggcatgattt

SEQ ID NO: 49601 - DNA, 71 bp, chicken (Gallus Gallus)
  misc_feature (36): n=c or g
gagctgaagctaggttaggcaaatagctacttgacnatgctttcacagagttcactttatagtagcaatat

SEQ ID NO: 49602 - DNA, 71 bp, chicken (Gallus Gallus)
  misc_feature (36): n=a or t
ttaaaaccttgggaattctgtttatggagcagaacnttcctgctatgggggcacagccacgctgtgggcac

SEQ ID NO: 49603 - DNA, 71 bp, chicken (Gallus Gallus)
  misc_feature (36): n=c or g
cagctgagactcaaagtcctgaaccctcagggaacnaaaaagaatggcaaaacatcccaggagacttaatg

SEQ ID NO: 49604 - DNA, 71 bp, chicken (Gallus Gallus)
  misc_feature (36): n=c or g
aaatgtacagggagacaaccacagagggagttgcantagagaactcaggcctaccgagttgttcatcaagg

SEQ ID NO: 49605 - DNA, 71 bp, chicken (Gallus Gallus)
  misc_feature (36): n=a or t
tcttaataaaatgcactgataataaaacaatatgcnctacaggggagatatttattgtgtcttcctgcaaa

SEQ ID NO: 49606 - DNA, 71 bp, chicken (Gallus Gallus)
  misc_feature (36): n=a or t
taatgagaccctcattggagtctgttgaagtatgcnagtactatcactgcctccgaaggtttccttctaat

SEQ ID NO: 49607 - DNA, 71 bp, chicken (Gallus Gallus)
  misc_feature (36): n=c or g
agttactgctccttatagctcttcctacaactttcntgaaatagctggtgtatctagacttgaaggtgtta

SEQ ID NO: 49608 - DNA, 71 bp, chicken (Gallus Gallus)
  misc_feature (36): n=a or t
ctgtggtatgtctgagtgcacctgtatacctactanattctgaattggtgactgaaatcagtacgtttggg

SEQ ID NO: 49609 - DNA, 71 bp, chicken (Gallus Gallus)
  misc_feature (36): n=c or g
tctgtaagtggactgctcaggcatttatcactttanaggtatggtccacatcctatttcactagacttaac

SEQ ID NO: 49610 - DNA, 71 bp, chicken (Gallus Gallus)
  misc_feature (36): n=c or g
atggattgcttgtaacacagccaccatctgcccatngagttctgacttagcccatcctgctcgttttagag

SEQ ID NO: 49611 - DNA, 71 bp, chicken (Gallus Gallus)
  misc_feature (36): n=c or g
caggcattgtctggccagcatttacatttctacagncatttacttcttcagtttaacgttccaccatgctg

SEQ ID NO: 49612 - DNA, 71 bp, chicken (Gallus Gallus)
  misc_feature (36): n=a or t
cagaacatgtggaattactgagcaagtaaagacttnagagaagagttgtttatttgtttcactttgctcat

SEQ ID NO: 49613 - DNA, 71 bp, chicken (Gallus Gallus)
  misc_feature (36): n=a or t
ttatctcaacaaacgtcacacagaagagattattgnggctttctgcaagtgacttcaaagtttgattgaga

SEQ ID NO: 49614 - DNA, 71 bp, chicken (Gallus Gallus)
  misc_feature (36): n=c or g
aatgacaaatcagaaactgctttaaagttataaaantcacagtggcatctaaaaataatgcaactttggat

SEQ ID NO: 49615 - DNA, 71 bp, chicken (Gallus Gallus)
  misc_feature (36): n=a or t
gagatgtgctctaagtgctaagctttaatgcctgtnttcatcacaccacagaaatgcttaccccatgaaat

SEQ ID NO: 49616 - DNA, 71 bp, chicken (Gallus Gallus)
  misc_feature (36): n=a or t
aaaaattaatacccatcccagagtgtcatgaatccnacaaatcatctccagagctaaacgtctaagaaggc

SEQ ID NO: 49617 - DNA, 71 bp, chicken (Gallus Gallus)
  misc_feature (36): n=a or t
ggcatattagaatttatctgtgtaagtttagctgtnattagctgcaaaacataatcacagttttaatgcta

SEQ ID NO: 49618 - DNA, 71 bp, chicken (Gallus Gallus)
  misc_feature (36): n=c or g
aaaaatgtattcaaggacatcacacgttttgtcttnagtatctttgtatgtctttcactatgcatattggg

SEQ ID NO: 49619 - DNA, 71 bp, chicken (Gallus Gallus)
  misc_feature (36): n=a or t
catccatttgaatttagaattaaataactacttccngtttggaattttcacaagattgcactcaaaagcca

SEQ ID NO: 49620 - DNA, 71 bp, chicken (Gallus Gallus)
  misc_feature (36): n=a or t
ctgagtagagcaaataagaaatatctcgccattccnattaatgctctttacatcacagcactcaaatccac

SEQ ID NO: 49621 - DNA, 71 bp, chicken (Gallus Gallus)
  misc_feature (36): n=a or t
ccagtgagagcagtgactaagaccgaaatttctganacaagcatcagtgtgtaactggatacaaagatctc

SEQ ID NO: 49622 - DNA, 71 bp, chicken (Gallus Gallus)
  misc_feature (36): n=a or t
ataatacatagatattcttagtcagtgaaaccatanataaagttttcatgtcacactggaataattgactg

SEQ ID NO: 49623 - DNA, 71 bp, chicken (Gallus Gallus)
  misc_feature (36): n=c or g
acacaaacatttttctccttgttggtgtttaaacancgtgttcatagatctctttaactgaggcagaatgc

SEQ ID NO: 49624 - DNA, 71 bp, chicken (Gallus Gallus)
  misc_feature (36): n=c or g
tgatgcatttgggtggataaaaggcactaacagcancaatgagcaacagggagggaagggtaaagagatcc

SEQ ID NO: 49625 - DNA, 71 bp, chicken (Gallus Gallus)
  misc_feature (36): n=c or g
tcaatagcaacttagcactaatgattgcttagggtnaatgactggaagtgaaacaagacaacacatgatga

SEQ ID NO: 49626 - DNA, 71 bp, chicken (Gallus Gallus)
  misc_feature (36): n=a or t
acaacaaaaactatcaaccagcttgatatttggaantctagccaaatagcttctgttaagacctatagact

SEQ ID NO: 49627 - DNA, 71 bp, chicken (Gallus Gallus)
  misc_feature (36): n=c or g
ggcatctgagagcttaaacgtgcacattattagcancaaagggacaaatagagctgtaactgagaaatgtt

SEQ ID NO: 49628 - DNA, 71 bp, chicken (Gallus Gallus)
  misc_feature (36): n=c or g
tcagatgggctgagggatacggccaagaggctgcanagcgatagcacccagactctgtcccctgttgtttg

SEQ ID NO: 49629 - DNA, 71 bp, chicken (Gallus Gallus)
  misc_feature (36): n=c or g
cattcgttggtatcgcaggtgacaccaacacactgntcttgtggtgaaactcaagagcaaaactcactgga

SEQ ID NO: 49630 - DNA, 71 bp, chicken (Gallus Gallus)
  misc_feature (36): n=c or g
ttttaactggaggtagctttctgttcagaagtattntggttttaagaggaagttctcttcagcagccttta

SEQ ID NO: 49631 - DNA, 71 bp, chicken (Gallus Gallus)
  misc_feature (36): n=c or g
atcaagctgaaagctttttgtaagatttgttttccnttggaacaagctgagagccactgcacagctacaga

SEQ ID NO: 49632 - DNA, 71 bp, chicken (Gallus Gallus)
  misc_feature (36): n=c or g
cagtcttcagtaagagagggacacccatctttagangggcagaagggaaggctcccagtttctctttttaa

SEQ ID NO: 49633 - DNA, 71 bp, chicken (Gallus Gallus)
  misc_feature (36): n=c or g
ccatcatgctcatctctctgtgtttcgtagctatanttagacgagctagttgctaaaatattagttggcgt

SEQ ID NO: 49634 - DNA, 71 bp, chicken (Gallus Gallus)
  misc_feature (36): n=a or t
cacataagctatgattttattgaaaatcctccaacngcatgttacatttccccagtatagccgtatttaag

SEQ ID NO: 49635 - DNA, 71 bp, chicken (Gallus Gallus)
  misc_feature (36): n=a or t
tccaacaatggacatggatgcaaagttgtttgaatntcaacagaagaaaaagaacaagagacagattataa

SEQ ID NO: 49636 - DNA, 71 bp, chicken (Gallus Gallus)
  misc_feature (36): n=c or g
tcagaactttgtaaagaaagcagtgaagcttgcaantagtgctccacgttcatttctattcctttttctca

SEQ ID NO: 49637 - DNA, 71 bp, chicken (Gallus Gallus)
  misc_feature (36): n=c or g
acatcgatatgcaaatttcagttttgatttgcaaantcttctaagaatcactacagaacgtggcagtgtca

SEQ ID NO: 49638 - DNA, 71 bp, chicken (Gallus Gallus)
  misc_feature (36): n=c or g
agcctttggctggcaaccgatctaccacagaagatnagagaagcataaaaagggtaaagatcatctttaaa

SEQ ID NO: 49639 - DNA, 71 bp, chicken (Gallus Gallus)
  misc_feature (36): n=c or g
attttcataattttcttaggatgtgctgataaattnttcctttgtaccatagtactcttcaccagaatata

SEQ ID NO: 49640 - DNA, 71 bp, chicken (Gallus Gallus)
  misc_feature (36): n=c or g
gcattatctttatggggcaatgttacacttgaactnagtctgtcttcttgaacagtgggtaagatgtgaac

SEQ ID NO: 49641 - DNA, 71 bp, chicken (Gallus Gallus)
  misc_feature (36): n=c or g
tggccacaaacctctgcagctgccaggctcaggganagaacagcatcatccgggtttacattctagttttt

SEQ ID NO: 49642 - DNA, 71 bp, chicken (Gallus Gallus)
  misc_feature (36): n=c or g
gattacaacacttaaattgatcgtttctgcatacanatctaccactgaaatactgcagaggttttggagcc

SEQ ID NO: 49643 - DNA, 71 bp, chicken (Gallus Gallus)
  misc_feature (36): n=a or t
ctgtagattcaagttggtcctgatgtaaaggcatantttttaaaagggtagagactcctacagtcaatatg

SEQ ID NO: 49644 - DNA, 71 bp, chicken (Gallus Gallus)
  misc_feature (36): n=a or t
gaataactaagagatatttgtgctgggtcttgtacngcagaggcatcagaaagagaaggctccttgagaga

SEQ ID NO: 49645 - DNA, 71 bp, chicken (Gallus Gallus)
  misc_feature (36): n=c or g
ccaagccagtttttctgtaactgcaatggcagtganacactgtcctatgatttattgaaatggctgatcac

SEQ ID NO: 49646 - DNA, 71 bp, chicken (Gallus Gallus)
  misc_feature (36): n=a or t
cctaatgcagaaagtaaaaacaattcagtaaaattnattctactacctaaacatcgggcgaactaagctgg

SEQ ID NO: 49647 - DNA, 71 bp, chicken (Gallus Gallus)
  misc_feature (36): n=a or t
tttaaaattccttccaaaaagggcacagaaaattanttcactgtatcatctcctacagatttgtgtatatg

SEQ ID NO: 49648 - DNA, 71 bp, chicken (Gallus Gallus)
  misc_feature (36): n=c or g
acctagagaaatttatatttcctaactaagctgtgncatttataatatcacattgccacacatcaaaattt

SEQ ID NO: 49649 - DNA, 71 bp, chicken (Gallus Gallus)
  misc_feature (36): n=a or t
tttatttttcccacaggtatggtatatcaaagttanttttatacactattacacaacagtattatcatgtc

SEQ ID NO: 49650 - DNA, 71 bp, chicken (Gallus Gallus)
  misc_feature (36): n=c or g
tagactgacagtagaggtcctgggaaaattttgtgntcatatagatcccccccatcttggtcaaaatgcag

SEQ ID NO: 49651 - DNA, 71 bp, chicken (Gallus Gallus)
  misc_feature (36): n=a or t
gttgttatttggaagtctgagattctctttctttcnaaaggaaaaagttccttgacgattcgtagttctgt

SEQ ID NO: 49652 - DNA, 71 bp, chicken (Gallus Gallus)
  misc_feature (36): n=a or t
tcattgtatgttggtgaatagatgaaacaagaacanaataaaccacattctgaattgtaactttctacatt

SEQ ID NO: 49653 - DNA, 71 bp, chicken (Gallus Gallus)
  misc_feature (36): n=a or t
caattcagacaactttgttcagtcatgcatagtccnaccagcactgggcaactcatgtgctagagctttaa

SEQ ID NO: 49654 - DNA, 71 bp, chicken (Gallus Gallus)
  misc_feature (36): n=c or g
tgagtattgtaactacaaaagtattaatttttggantcataactgccaagattgttgaaatatccatacca

SEQ ID NO: 49655 - DNA, 71 bp, chicken (Gallus Gallus)
  misc_feature (36): n=c or g
ttgtgtcctatagaatgtagaagcacagactatatntatcccatattttggatttgttcttgagtgcttac

SEQ ID NO: 49656 - DNA, 71 bp, chicken (Gallus Gallus)
  misc_feature (36): n=a or t
gcttatttcctagtggttcaagtagacagtgtatanttcagaaatccctgtcctttgttttgttttccatt

SEQ ID NO: 49657 - DNA, 71 bp, chicken (Gallus Gallus)
  misc_feature (36): n=c or g
tttgagtttatcattatgtgaacagggcagggcaanacatggatcaggattgagacatctgcccttgaaga

SEQ ID NO: 49658 - DNA, 71 bp, chicken (Gallus Gallus)
  misc_feature (36): n=a or t
ctccttacttctgatatgaatgaaattgcttctctnctactcacttagacactcaacatttgttattccca

SEQ ID NO: 49659 - DNA, 71 bp, chicken (Gallus Gallus)
  misc_feature (36): n=c or g
tgtatttctctttagctctgtttaaaaagcaagggnacaaaactggaagcaaatctcggcatggatgaact

SEQ ID NO: 49660 - DNA, 71 bp, chicken (Gallus Gallus)
  misc_feature (36): n=a or t
gggaaaaagtcactgggatttttggataggcaatantttttttccacaagtgagctggtcaataagaagac

SEQ ID NO: 49661 - DNA, 71 bp, chicken (Gallus Gallus)
  misc_feature (36): n=c or g
tcccatcaccgagttttccagttagagttggtgcantctggtctggggctcaagtgcagaatgggcttaag

SEQ ID NO: 49662 - DNA, 71 bp, chicken (Gallus Gallus)
  misc_feature (36): n=c or g
ttgcaaaacaaagaagcaagctttggttcaggtatnagtctggtatgttgttcattattttcctaggtctc

SEQ ID NO: 49663 - DNA, 71 bp, chicken (Gallus Gallus)
  misc_feature (36): n=a or t
tatgtcaaatgcatgcacttccatgtagtattgctntttctagtttcggcttgaagaacttctaacatcat

SEQ ID NO: 49664 - DNA, 71 bp, chicken (Gallus Gallus)
  misc_feature (36): n=c or g
tggcagcattgtcatggtcccaaagggaaataaatnctcctaacaatttctgacaaaccagcctagcaaag

SEQ ID NO: 49665 - DNA, 71 bp, chicken (Gallus Gallus)
  misc_feature (36): n=a or t
tcacagcttcctggagaagttccttgtcgtcccttnatggttattctctttggtgcatgactcacatacca

SEQ ID NO: 49666 - DNA, 71 bp, chicken (Gallus Gallus)
  misc_feature (36): n=c or g
tgaagttcacccatacatctctcacactgaccaaanaggtggaagggtgtgcggagcaaaagtgtgttgct

SEQ ID NO: 49667 - DNA, 71 bp, chicken (Gallus Gallus)
  misc_feature (36): n=a or t
aaatattattctgtggaatatatagcaaaaggtagnctttatatctcttaatagtaaatctccaaagttaa

SEQ ID NO: 49668 - DNA, 71 bp, chicken (Gallus Gallus)
  misc_feature (36): n=c or g
aagcacacccaccctgtgccctccttccttcgtttncttccccatatactgtttgcatgggaggttcctgt

SEQ ID NO: 49669 - DNA, 71 bp, chicken (Gallus Gallus)
  misc_feature (36): n=c or g
cagacaataaatattattccatctcattcttaatantgaaccaaagtaggatattttacctacagaatcgt

SEQ ID NO: 49670 - DNA, 71 bp, chicken (Gallus Gallus)
  misc_feature (36): n=c or g
atccaactcactaacctaagaaagcattcaatcttnatttattacaagtgatttcactgtcaagtcagtaa

SEQ ID NO: 49671 - DNA, 71 bp, chicken (Gallus Gallus)
  misc_feature (36): n=c or g
acacatttctactcttggtgacacacttcccacatngggtacagcccattcatgccatcactgctgcgtgt

SEQ ID NO: 49672 - DNA, 71 bp, chicken (Gallus Gallus)
  misc_feature (36): n=c or g
gttacagccatgctgaaagggctcctgcctactgancgtgcacaaagacatggccaagctctttctgtgtg

SEQ ID NO: 49673 - DNA, 71 bp, chicken (Gallus Gallus)
  misc_feature (36): n=a or t
gccagacacggtctgaaatccaacctttgacatggncactgagaactgaactttgacagaaagtcctggac

SEQ ID NO: 49674 - DNA, 71 bp, chicken (Gallus Gallus)
  misc_feature (36): n=c or g
tctgggaacaaacgacgtcttaataacaccagaccntgcaaatctaattagcgacacaaccgaactactaa

SEQ ID NO: 49675 - DNA, 71 bp, chicken (Gallus Gallus)
  misc_feature (36): n=c or g
aaagtctacattctctctgttgtctttcatgcctantggcagacactctggaatcaaaggcagtgaagacc

SEQ ID NO: 49676 - DNA, 71 bp, chicken (Gallus Gallus)
  misc_feature (36): n=a or t
tgtacaggtatacttgtccctatatatgaggcactntacagcattcacatattaaacgcttctaatttcat

SEQ ID NO: 49677 - DNA, 71 bp, chicken (Gallus Gallus)
  misc_feature (36): n=c or g
ggttttaagctgaagctcagtaacagctgtctgttnagcagggcaaggtgagaagcgtgctgtgatgctgt

SEQ ID NO: 49678 - DNA, 71 bp, chicken (Gallus Gallus)
  misc_feature (36): n=a or t
ttcaggtccccagatctaagcaattaaagcaggcanagaaatgcagttttacctttgaatgtttctagtag

SEQ ID NO: 49679 - DNA, 71 bp, chicken (Gallus Gallus)
  misc_feature (36): n=c or g
gcaatgccactttctcctcagtatcttctcccacantggcgtgtcactttgtcttaccatgctgccagcta

SEQ ID NO: 49680 - DNA, 71 bp, chicken (Gallus Gallus)
  misc_feature (36): n=c or g
gcttttccagcatttaatatctcagaagtataaaanattacatgttcctctcttttaccacatccaaaacg

SEQ ID NO: 49681 - DNA, 71 bp, chicken (Gallus Gallus)
  misc_feature (36): n=a or t
cctttcctttggatctgataaaatcttttgggaatnaaacacatgtctgtggggtagtatagctttttatg

SEQ ID NO: 49682 - DNA, 71 bp, chicken (Gallus Gallus)
  misc_feature (36): n=c or g
catagccatgcctcatcgcctggcatcagctgtgantgtaggcagatgaactggactgagaccgagtattt

SEQ ID NO: 49683 - DNA, 71 bp, chicken (Gallus Gallus)
  misc_feature (36): n=c or g
taaaatactggagagaaattaacctaattcttgaantaaaatgtttacttaagtcctctcttgaaccatta

SEQ ID NO: 49684 - DNA, 71 bp, chicken (Gallus Gallus)
  misc_feature (36): n=c or g
gatattattttctcaccattttggtatattttaatncagtattgctacattgatgtcacaagcagtttttg

SEQ ID NO: 49685 - DNA, 71 bp, chicken (Gallus Gallus)
  misc_feature (36): n=c or g
atagctggacacatcaaatccactgagatcaggagnagagccaaaggtcagggcttgggcacaaagatgct

SEQ ID NO: 49686 - DNA, 71 bp, chicken (Gallus Gallus)
  misc_feature (36): n=c or g
tgaataaagccccaaatctatttccaacatcttccntgttttcacccttcagtttttaaccatgcaagggg

SEQ ID NO: 49687 - DNA, 71 bp, chicken (Gallus Gallus)
  misc_feature (36): n=c or g
agtatgttcactgtagactgacagaaaataaatggnaagactgtaggcccaaacatgtgaactgctgtgta

SEQ ID NO: 49688 - DNA, 71 bp, chicken (Gallus Gallus)
  misc_feature (36): n=c or g
aaggaatactaaagtacgctcttcccatggtacgtnagcatggacaggacacagaacacactctccgtgac

SEQ ID NO: 49689 - DNA, 71 bp, chicken (Gallus Gallus)
  misc_feature (36): n=c or g
catcactgaccacattgtttacaggcctccaggttntaacaaggcaaggtagatcccagttgttgatacta

SEQ ID NO: 49690 - DNA, 71 bp, chicken (Gallus Gallus)
  misc_feature (36): n=c or g
aaatgcaaacaatcctaatggcaaaggagtgatatnctccaaatgcacgcatcatgcctttctgaaccagt

SEQ ID NO: 49691 - DNA, 71 bp, chicken (Gallus Gallus)
  misc_feature (36): n=a or t
ataagtgaagagccattcattcactcacaggaccangctgtcacataatgaggctcccatctggtaaaata

SEQ ID NO: 49692 - DNA, 71 bp, chicken (Gallus Gallus)
  misc_feature (36): n=c or g
aaaatgcagacaggttaagactggccaaaagaaatnctcacaaggattgtaggattgtaggatgtaggagg

SEQ ID NO: 49693 - DNA, 71 bp, chicken (Gallus Gallus)
  misc_feature (36): n=c or g
gcttcagttcttgtgtaaaggcagcgtcttctactntagagcagaaaaaaggtagacaagtaagtagtaca

SEQ ID NO: 49694 - DNA, 71 bp, chicken (Gallus Gallus)
  misc_feature (36): n=a or t
acttgttgacctaagcaagtaaaaaacttgagtatnacttaaaaagaaactatcatatcctttgacttgat

SEQ ID NO: 49695 - DNA, 71 bp, chicken (Gallus Gallus)
  misc_feature (36): n=a or t
gctcttctcaagtatctcctcaacatttggaagtgntttttttcctaccaaaatcttccctgccacctcac

SEQ ID NO: 49696 - DNA, 71 bp, chicken (Gallus Gallus)
  misc_feature (36): n=a or t
gagagagtggcacgaaacgtacacaacagtcaagtnaaaagcttggggaaataagcgtggcactgtgggtc

SEQ ID NO: 49697 - DNA, 71 bp, chicken (Gallus Gallus)
  misc_feature (36): n=c or g
atcatgctctaaaagaaagctgtctgagtgcctgtnacaagtgacaccagtaaaataactctccatgttct

SEQ ID NO: 49698 - DNA, 71 bp, chicken (Gallus Gallus)
  misc_feature (36): n=a or t
ttgtgagagctgctgacatcagtgaaatcttgtgtntaatattgggtagcatgagattcacatccctctgc

SEQ ID NO: 49699 - DNA, 71 bp, chicken (Gallus Gallus)
  misc_feature (36): n=a or t
cataaagacagggtagggcaatgagtaaatggatcngttacattcttcttctatcacactgcattaacagt

SEQ ID NO: 49700 - DNA, 71 bp, chicken (Gallus Gallus)
  misc_feature (36): n=c or g
aatcagcagcatgtgagataaacagctctttagganagaagaacaaggggaacagagaggctgtgtgctca

SEQ ID NO: 49701 - DNA, 71 bp, chicken (Gallus Gallus)
  misc_feature (36): n=c or g
gtgacttctacatcttcctcctacttctagtcagantggtttttcttcctgtctgtttgactgctagttga

SEQ ID NO: 49702 - DNA, 71 bp, chicken (Gallus Gallus)
  misc_feature (36): n=c or g
ttgaagatggtaaactgtgatctcttaggtctaatnacagccctgaacctactctttctttttgttgcctg

SEQ ID NO: 49703 - DNA, 71 bp, chicken (Gallus Gallus)
  misc_feature (36): n=c or g
tcataaagatcccatctggaattttcagtagaagtntcagctgatatggtgataccgactctggtatctca

SEQ ID NO: 49704 - DNA, 71 bp, chicken (Gallus Gallus)
  misc_feature (36): n=a or t
agaagctgttgtccttcctggcacgcctgtctaaanttccataagtatttcctgataaagcagatccaaat

SEQ ID NO: 49705 - DNA, 71 bp, chicken (Gallus Gallus)
  misc_feature (36): n=c or g
tgtaatgagaaattgagtagtgatgaggatgcttanctacagaatccaaccaaattcttctgatcccctct

SEQ ID NO: 49706 - DNA, 71 bp, chicken (Gallus Gallus)
  misc_feature (36): n=a or t
aggcaaagcctcatgattattgtcccagggaactgnaaccttttagaagaaaaaatattttacttgtagtt

SEQ ID NO: 49707 - DNA, 71 bp, chicken (Gallus Gallus)
  misc_feature (36): n=c or g
gatacagaaattgaaaggctgcagaacctgggcagnagtctcgctctctgaggagacaaaccctcccttgg

SEQ ID NO: 49708 - DNA, 71 bp, chicken (Gallus Gallus)
  misc_feature (36): n=a or t
ttcgtgaagttcctccttggaatgctggagtttgcnctctaagctctcaatctgaacagaaaattcaattg

SEQ ID NO: 49709 - DNA, 71 bp, chicken (Gallus Gallus)
  misc_feature (36): n=a or t
ttaatgagctaagtttagagattactttgcattccntttaaattctacttgaattctgaaataatgagaga

SEQ ID NO: 49710 - DNA, 71 bp, chicken (Gallus Gallus)
  misc_feature (36): n=a or t
tttcaatttgtaatctggattttaattaagcagtcnatacaaaatactctaaaaaccttctaacgctgtgc

SEQ ID NO: 49711 - DNA, 71 bp, chicken (Gallus Gallus)
  misc_feature (36): n=c or g
cgatgggtgcaaacgtgtcttgttggagctgatgtnttatggaagagccctttctgttttgtgcgcatccc

SEQ ID NO: 49712 - DNA, 71 bp, chicken (Gallus Gallus)
  misc_feature (36): n=c or g
tagatattagaagtatgctgacaagctgagaagttnttcagagatgttttacactgatttatttgaatcat

SEQ ID NO: 49713 - DNA, 71 bp, chicken (Gallus Gallus)
  misc_feature (36): n=c or g
tatcagagtaatgctaactaatctttgtttagactntctttctatacttttcttcagagttccatgttaat

SEQ ID NO: 49714 - DNA, 71 bp, chicken (Gallus Gallus)
  misc_feature (36): n=c or g
aactttatacgtagtcagaattgcaagtgcaaaatncttaaacctgttctgcttgcattgcacttattgat

SEQ ID NO: 49715 - DNA, 71 bp, chicken (Gallus Gallus)
  misc_feature (36): n=c or g
cgtgctacactgccaaagcaggccgctgggatctgntggctgctttaatcagagaagcatacagcttcata

SEQ ID NO: 49716 - DNA, 71 bp, chicken (Gallus Gallus)
  misc_feature (36): n=c or g
gctgctgtgaatgcacaataagtgcatcactaacancattcagttgttagacttacagacacacagtaatc

SEQ ID NO: 49717 - DNA, 71 bp, chicken (Gallus Gallus)
  misc_feature (36): n=c or g
gaaagtggtgtgggaatgctgattaaatggctgttnttacagaaagatcaatgtgatggaaaggagacaca

SEQ ID NO: 49718 - DNA, 71 bp, chicken (Gallus Gallus)
  misc_feature (36): n=c or g
acttagggcatgtatgtcaggtcaaataagaactgncagataaggaaaagcgactgtagccagcacaatat

SEQ ID NO: 49719 - DNA, 71 bp, chicken (Gallus Gallus)
  misc_feature (36): n=a or t
tcctgcaccttgcgttaaacagttcttcccaaagtnaagtcttttacacgttaggtgtttaatattctatc

SEQ ID NO: 49720 - DNA, 71 bp, chicken (Gallus Gallus)
  misc_feature (36): n=a or t
cttagcatgaagacccaaagttgaagcgtttcatcncaagactgtcagactaattaacagattccctccat

SEQ ID NO: 49721 - DNA, 71 bp, chicken (Gallus Gallus)
  misc_feature (36): n=c or g
aattactttttgttctaaattataagaactagattnaaagcttcctggggagtttcagagggatacaaaag

SEQ ID NO: 49722 - DNA, 71 bp, chicken (Gallus Gallus)
  misc_feature (36): n=a or t
ctttcagatgagacacaatggacaaatgcagcaagnaagaggtaaagaggtctacttacctgatcaggata

SEQ ID NO: 49723 - DNA, 71 bp, chicken (Gallus Gallus)
  misc_feature (36): n=c or g
gcaatttcacacctgaaattaagttgcatgaaatcnatgatcttcacatctgcttcagatcagcagatggc

SEQ ID NO: 49724 - DNA, 71 bp, chicken (Gallus Gallus)
  misc_feature (36): n=c or g
acataccattgtccttggtggaagaagcctctaagnaagagttcctttgtagtgaaagaaagtgggagcac

SEQ ID NO: 49725 - DNA, 71 bp, chicken (Gallus Gallus)
  misc_feature (36): n=c or g
attgcaagggctgtgtttctcaaaataacttcccanttaagtttctgccgctaagcagtcttctgcagaga

SEQ ID NO: 49726 - DNA, 71 bp, chicken (Gallus Gallus)
  misc_feature (36): n=c or g
ttgctgataaatatattaaaacctttagagcagaanaatatagcaatgtttgtttggacaatccttgactt

SEQ ID NO: 49727 - DNA, 71 bp, chicken (Gallus Gallus)
  misc_feature (36): n=a or t
tatttgacaacaaaagtgtgatcccagttgagtttnaatgacagaattgtggctacttctgtatgctttca

SEQ ID NO: 49728 - DNA, 71 bp, chicken (Gallus Gallus)
  misc_feature (36): n=c or g
ctgttgtaggtcacaggctgagttcgttcatgaagnagactgtcagaacattcgatgcactggggtaagtt

SEQ ID NO: 49729 - DNA, 71 bp, chicken (Gallus Gallus)
  misc_feature (36): n=c or g
aggtgaagctgacatcttcttccatgcctgtgctantgacacagagcattgcaaatgactctctgccgggc

SEQ ID NO: 49730 - DNA, 71 bp, chicken (Gallus Gallus)
  misc_feature (36): n=c or g
aaaacgagtaatcccaagacagaaaacttaaaaccnctaaaatgggatttccagtcatgccagtgaaaaca

SEQ ID NO: 49731 - DNA, 71 bp, chicken (Gallus Gallus)
  misc_feature (36): n=c or g
ttgggcattcaaattcagcccactgtaggcagaggnagatcacttggcccacgccaaacacagtccccctt

SEQ ID NO: 49732 - DNA, 71 bp, chicken (Gallus Gallus)
  misc_feature (36): n=c or g
ccttcagtgattcatgatggagacaaatgttaactnaacaaggatgaagggcaggctgtgaaacaatgata

SEQ ID NO: 49733 - DNA, 71 bp, chicken (Gallus Gallus)
  misc_feature (36): n=a or t
taatccttctgctttgattggcttctttgctcaganttttcaagctgtttgccagcagtaagtgcaccacc

SEQ ID NO: 49734 - DNA, 71 bp, chicken (Gallus Gallus)
  misc_feature (36): n=c or g
gtgtgtttagaaagaaatctaacatggaatcaacanagctatgcgggtctttatgatgtgacagacgttgt

SEQ ID NO: 49735 - DNA, 71 bp, chicken (Gallus Gallus)
  misc_feature (36): n=c or g
gttgctagaattaaccctttccctgacaactattantttgccagtaagtgaatttctgctacttttgcact

SEQ ID NO: 49736 - DNA, 71 bp, chicken (Gallus Gallus)
  misc_feature (36): n=c or g
agactgtactaatttgtctttagctattaaaagtanaatagctttcagataccaccagcagagagagacct

SEQ ID NO: 49737 - DNA, 71 bp, chicken (Gallus Gallus)
  misc_feature (36): n=a or t
tgcactgcattcaagctgcatttgaaggaagcaatnttataatacttgaacgtggcatatcccaacacttc

SEQ ID NO: 49738 - DNA, 71 bp, chicken (Gallus Gallus)
  misc_feature (36): n=c or g
aaacaagattgatgaagtcaaacagccagtaacaantaagacactgcccacaggtagaaaatactgaatgt

SEQ ID NO: 49739 - DNA, 71 bp, chicken (Gallus Gallus)
  misc_feature (36): n=a or t
tggtgagacttcattcacttcctttatgtttttttnaaatcttggtgttactattaaaggttaacttctta

SEQ ID NO: 49740 - DNA, 71 bp, chicken (Gallus Gallus)
  misc_feature (36): n=a or t
acaaactgagttctgtgctttgtggaagacttttcnaatgttttgcttcacagccaaagctgcctacttga

SEQ ID NO: 49741 - DNA, 71 bp, chicken (Gallus Gallus)
  misc_feature (36): n=c or g
tgcatgtaattcatctcatcaaacatattttttctnatgtttcaccattctttctgtttccctatttgatt

SEQ ID NO: 49742 - DNA, 71 bp, chicken (Gallus Gallus)
  misc_feature (36): n=c or g
ctattaaataaaatcggctcctgccttggtgagtantatgtatcccttttcagaaacttaaaagctgaaag

SEQ ID NO: 49743 - DNA, 71 bp, chicken (Gallus Gallus)
  misc_feature (36): n=c or g
tatcaggttaaacaagttcacgttttagttttcaantgttacttttggaatttggtgaagatattccactt

SEQ ID NO: 49744 - DNA, 71 bp, chicken (Gallus Gallus)
  misc_feature (36): n=c or g
cacactgacctcctacaaccccagcctagtgggaanacatccaacctcttgcctagttcaaagcaagccta

SEQ ID NO: 49745 - DNA, 71 bp, chicken (Gallus Gallus)
  misc_feature (36): n=c or g
ttttgaaacagcagtccaggtactttaaagccttcntataccaacgtcactgatgatcacagaacacatca

SEQ ID NO: 49746 - DNA, 71 bp, chicken (Gallus Gallus)
  misc_feature (36): n=c or g
ccttcaccgggccatgcattgttcaaaagccaaaanagctgcagtgctgggatcatgcctctgcacaggta

SEQ ID NO: 49747 - DNA, 71 bp, chicken (Gallus Gallus)
  misc_feature (36): n=c or g
acaaaacagcaaaggaggtgtgtaggtggaacttanaaaaatctcacagaaatcagttggcctttatagaa

SEQ ID NO: 49748 - DNA, 71 bp, chicken (Gallus Gallus)
  misc_feature (36): n=c or g
aaccgaacagcgtaaaacagaagaagaatttgaaantcctattcagttgcattttttctactgagtcctga

SEQ ID NO: 49749 - DNA, 71 bp, chicken (Gallus Gallus)
  misc_feature (36): n=c or g
aatgaaaattggttgttggtatgctataacaaaganatgttttaacaaaacaacattttgatttttctgtc

SEQ ID NO: 49750 - DNA, 71 bp, chicken (Gallus Gallus)
  misc_feature (36): n=c or g
tgaggggataggcaagacagcaaaaggcttttctcntgctttaatctgcatctacgtggtagaagtgtgta

SEQ ID NO: 49751 - DNA, 71 bp, chicken (Gallus Gallus)
  misc_feature (36): n=c or g
cttgtgatagatgtgggactccagcagcagcagtgnctttaatctccccgtggttcctgttgagctgttga

SEQ ID NO: 49752 - DNA, 71 bp, chicken (Gallus Gallus)
  misc_feature (36): n=c or g
ccagagatttgcatttcaggatttactcagctgcanattttcacttgtttccttaacgttttccataagcg

SEQ ID NO: 49753 - DNA, 71 bp, chicken (Gallus Gallus)
  misc_feature (36): n=c or g
ccatcccaaacactgctctgtttgagcagcgaggantgacttggctgatcatcttttcagtagatgctgaa

SEQ ID NO: 49754 - DNA, 71 bp, chicken (Gallus Gallus)
  misc_feature (36): n=a or t
gtatcatttcatctggttttgttccctgtgaaggtntacaagatattatttgtcttagaatataatactct

SEQ ID NO: 49755 - DNA, 71 bp, chicken (Gallus Gallus)
  misc_feature (36): n=c or g
ccagggggaggctaaagctgcgacccaatctggccnaagtcccacacctttaatcttgcaaatcttcttta

SEQ ID NO: 49756 - DNA, 71 bp, chicken (Gallus Gallus)
  misc_feature (36): n=c or g
gctgttttttgtaactggtgagtctcagagttatgncagaaatcctttttgtcactcaaaatctttcactt

SEQ ID NO: 49757 - DNA, 71 bp, chicken (Gallus Gallus)
  misc_feature (36): n=a or t
tgggaatcagcttctccagtccaactagccctgcangctgtcagcagagccctttttctagagattgctag

SEQ ID NO: 49758 - DNA, 71 bp, chicken (Gallus Gallus)
  misc_feature (36): n=a or t
tggggtgtctgagcacatgcacggtgtgctctgccngtactccagtgaccgattatctcacactcattacc

SEQ ID NO: 49759 - DNA, 71 bp, chicken (Gallus Gallus)
  misc_feature (36): n=a or t
gccaagagtgtcttcacctctctagcaccattttangagtgattatttcatagcacagaaaatgtttctta

SEQ ID NO: 49760 - DNA, 71 bp, chicken (Gallus Gallus)
  misc_feature (36): n=a or t
tacaaagagaggtgcaagaatcctacaataagccantgtggtagaaagttaacttttgtacaaattcagga

SEQ ID NO: 49761 - DNA, 71 bp, chicken (Gallus Gallus)
  misc_feature (36): n=c or g
gcagatggtggtgctcctatcatctcttcagaaaanaatacattaagggtagtgccccactgtctgtttga

SEQ ID NO: 49762 - DNA, 71 bp, chicken (Gallus Gallus)
  misc_feature (36): n=c or g
gttttaaagtataatttgtttaagggaatgcatttntgccagcctgtattttatctgacttgttataaagc

SEQ ID NO: 49763 - DNA, 71 bp, chicken (Gallus Gallus)
  misc_feature (36): n=c or g
tgccatttcactccctataaataccctatgaacacnagctgtgcaggtggcaatgcccagcctggcagcac

SEQ ID NO: 49764 - DNA, 71 bp, chicken (Gallus Gallus)
  misc_feature (36): n=a or t
ttttctagaccacccacactgtgtatcagtcctttntgggaaggggaaaaagccccaaatctttgcttgct

SEQ ID NO: 49765 - DNA, 71 bp, chicken (Gallus Gallus)
  misc_feature (36): n=c or g
ttaattaaaacaatcatcacaactcagggaagactnggtctccctaaccctcgccagggtttgtggagata

SEQ ID NO: 49766 - DNA, 71 bp, chicken (Gallus Gallus)
  misc_feature (36): n=c or g
tcagacacgaagctcagacatcatcattcaagctgntaggtcagtgtatggggcagtctgtctatcagctg

SEQ ID NO: 49767 - DNA, 71 bp, chicken (Gallus Gallus)
  misc_feature (36): n=c or g
ttccaaaaggacaagaaaagagctcgatgctttccncccccctctctgcacccacagaacgggttggctca

SEQ ID NO: 49768 - DNA, 71 bp, chicken (Gallus Gallus)
  misc_feature (36): n=c or g
taagaaccaattacagccagaagctggacttagagntttgagtaaactagtgaacatgtttggtgacccca

SEQ ID NO: 49769 - DNA, 71 bp, chicken (Gallus Gallus)
  misc_feature (36): n=c or g
tttgagccatagagtggggctttggtaagctggganctgagggcagagctgttccctgtgcctgggggtgc

SEQ ID NO: 49770 - DNA, 71 bp, chicken (Gallus Gallus)
  misc_feature (36): n=c or g
cctcaaactacagtagcttttgaaagatcacacacnttattcacatcccaagagagtatatgcagataggc

SEQ ID NO: 49771 - DNA, 71 bp, chicken (Gallus Gallus)
  misc_feature (36): n=c or g
aaagatggattctcaagctgcttcttctgatagggntgatattagaggacatttggccaaaaaaggatgac

SEQ ID NO: 49772 - DNA, 71 bp, chicken (Gallus Gallus)
  misc_feature (36): n=a or t
actgaggtcccagaagacagcacatccatcaacctnagtctctcatctcagagatcatctggctcagtctc

SEQ ID NO: 49773 - DNA, 71 bp, chicken (Gallus Gallus)
  misc_feature (36): n=c or g
tcattccctggagagcccctttggtgggatccatgngggtcagcatggtgacaggcttacagacatagaac

SEQ ID NO: 49774 - DNA, 71 bp, chicken (Gallus Gallus)
  misc_feature (36): n=c or g
gtcgctcagttgtcccttcagatcccacgccgctcnacgacgatgggcgccgccgaccggagccgctgcag

SEQ ID NO: 49775 - DNA, 71 bp, chicken (Gallus Gallus)
  misc_feature (36): n=a or t
cctattcacatagaaaagtgtgtgacctagaaaagnactcagtgttttaaggaagagagaattgcaaagac

SEQ ID NO: 49776 - DNA, 71 bp, chicken (Gallus Gallus)
  misc_feature (36): n=c or g
tgcctccaactttgagactgctgtggtattataacntttaaaagcacactgtatcattccaatctatattt

SEQ ID NO: 49777 - DNA, 71 bp, chicken (Gallus Gallus)
  misc_feature (36): n=a or t
ctgggctttgggacagctcttcctgtaagttatgcntattttttcctaggagctaaaaatcagtaagaaac

SEQ ID NO: 49778 - DNA, 71 bp, chicken (Gallus Gallus)
  misc_feature (36): n=a or t
gtatgtttaagaacaggccaacacacactcaagttntttaacacagaattctcaattaagggttcatattt

SEQ ID NO: 49779 - DNA, 71 bp, chicken (Gallus Gallus)
  misc_feature (36): n=c or g
gtagattttatgactatcattttcagcaaggtccantctgatctattgcagtgtaaggcaattctctgctt

SEQ ID NO: 49780 - DNA, 71 bp, chicken (Gallus Gallus)
  misc_feature (36): n=c or g
attggttctattctaacactaaattaaaaacagtanatttgcagaagtcttcaaggtacattttaaaaata

SEQ ID NO: 49781 - DNA, 71 bp, chicken (Gallus Gallus)
  misc_feature (36): n=a or t
acaaggtttcaagaggccatcatatgctgtgagaantgcaagactgcagagccagctatgggagggataaa

SEQ ID NO: 49782 - DNA, 71 bp, chicken (Gallus Gallus)
  misc_feature (36): n=a or t
ccataaaatacttcttctcacctctgaagaaacctnttcctgattgcaaaaagtaggtattttgccatttg

SEQ ID NO: 49783 - DNA, 71 bp, chicken (Gallus Gallus)
  misc_feature (36): n=c or g
ctccaggagctgtatcagaccccacattctgtctgntcctttacttagaagaccacaggtaaataaaagga

SEQ ID NO: 49784 - DNA, 71 bp, chicken (Gallus Gallus)
  misc_feature (36): n=c or g
accaaaagctgttaaggccaagagcagtcctgctgncagaggtgagagttgggcagcaagaggtaaatgtg

SEQ ID NO: 49785 - DNA, 71 bp, chicken (Gallus Gallus)
  misc_feature (36): n=a or t
aatgtatgtggatgaatgcacgtgtactttagcacntttatcctgtcaataacacataaagtacaatgatg

SEQ ID NO: 49786 - DNA, 71 bp, chicken (Gallus Gallus)
  misc_feature (36): n=a or t
aaaaagaaggggaaaaaggcaaagctgcgcctcgtngtgcagatccatctgtttcccagcttataaacatc

SEQ ID NO: 49787 - DNA, 71 bp, chicken (Gallus Gallus)
  misc_feature (36): n=a or t
cacctcaaaacagaatctaatgttaaattcttatcngcgcagtcgaacccttgttagccagttagtggagg

SEQ ID NO: 49788 - DNA, 71 bp, chicken (Gallus Gallus)
  misc_feature (36): n=c or g
tccttgacaagctgctctgggtcctttgtcttcacnctctccagcttgccctcgccatcctccccagcatc

SEQ ID NO: 49789 - DNA, 71 bp, chicken (Gallus Gallus)
  misc_feature (36): n=c or g
cctttaacctgatatctgaatatggacagcatgcanattgtgcttctggcacagaatggagcaagcagtct

SEQ ID NO: 49790 - DNA, 71 bp, chicken (Gallus Gallus)
  misc_feature (36): n=a or t
tcgttatgggcctgcctggttatgggatgacctctnaacagaggagttaaaaagcatgccaaaaaagccag

SEQ ID NO: 49791 - DNA, 71 bp, chicken (Gallus Gallus)
  misc_feature (36): n=a or t
taggcaaacttagcacaagcagaatttgacttccangcttcatgggactgattaggaaatagatccatcct

SEQ ID NO: 49792 - DNA, 71 bp, chicken (Gallus Gallus)
  misc_feature (36): n=a or t
aaagggtttccttcctcacactcattcccctctagntatcctactcaacaagactgataatgtaaccatca

SEQ ID NO: 49793 - DNA, 71 bp, chicken (Gallus Gallus)
  misc_feature (36): n=c or g
tgcgctctgaaagcaccacacattcagtcaggctangagccttgtctttgaggtggtttgctgtgtgacat

SEQ ID NO: 49794 - DNA, 71 bp, chicken (Gallus Gallus)
  misc_feature (36): n=c or g
acttttgtatggcacgtatctcattatttcacatanatactaactttatgaatgggccatctctgcttcac

SEQ ID NO: 49795 - DNA, 71 bp, chicken (Gallus Gallus)
  misc_feature (36): n=c or g
actcttccagactacttttgtgttgtggacagtagngaaaatactgatgcctgtcatgtcttattcctttt

SEQ ID NO: 49796 - DNA, 71 bp, chicken (Gallus Gallus)
  misc_feature (36): n=a or t
ctacaagagaagccttaatgatgtcgtgggaaaagnactgaaacctcagttagaaagattttttttcccag

SEQ ID NO: 49797 - DNA, 71 bp, chicken (Gallus Gallus)
  misc_feature (36): n=a or t
gtgttcttaatgaagtgaaaggtgatgtcaaagctnagctatgaaagactggggacagctggatgaggtga

SEQ ID NO: 49798 - DNA, 71 bp, chicken (Gallus Gallus)
  misc_feature (36): n=c or g
tgcttggaaaggcagtcagtgtatcactcatcgttntaggacaggcaaaaatattattctgaacaaaatat

SEQ ID NO: 49799 - DNA, 71 bp, chicken (Gallus Gallus)
  misc_feature (36): n=a or t
atgattttcgagactggagaagactactgtttattnaaaaaaatagtcaaagatgttttacttttccattc

SEQ ID NO: 49800 - DNA, 71 bp, chicken (Gallus Gallus)
  misc_feature (36): n=a or t
aattgaattcttaaagttccttgttgggcttgtgcnctgtagtaaacacagggggaaggaataaatcacat

SEQ ID NO: 49801 - DNA, 71 bp, chicken (Gallus Gallus)
  misc_feature (36): n=c or g
aggcaacacaatcactgggaggaagtatgtgatggntggaagaaatgagcagggatcaggactttggggct

SEQ ID NO: 49802 - DNA, 71 bp, chicken (Gallus Gallus)
  misc_feature (36): n=c or g
ctgcacaaaatagcgccatcccttggaaaatccaanctactgagttgctaggtgacctcctttaaaggagg

SEQ ID NO: 49803 - DNA, 71 bp, chicken (Gallus Gallus)
  misc_feature (36): n=c or g
tatttactgtgcatatacttaaaaaaaaaaaaacanttactcactcctactcatcagctacaatttaggaa

SEQ ID NO: 49804 - DNA, 71 bp, chicken (Gallus Gallus)
  misc_feature (36): n=c or g
agcagcccccatttccatgcagggatccagacaagnagagatgaaactcacgacctgaaaacagctgactc

SEQ ID NO: 49805 - DNA, 71 bp, chicken (Gallus Gallus)
  misc_feature (36): n=c or g
tgcctcatactaggccatctccgcttgctgttgcanaagtaatttagacctacccctttatgcttataaga

SEQ ID NO: 49806 - DNA, 71 bp, chicken (Gallus Gallus)
  misc_feature (36): n=c or g
atgctactgtgaagtttcaagttacctcattctcangaaggacagggatttactctggtttcagctctttc

SEQ ID NO: 49807 - DNA, 71 bp, chicken (Gallus Gallus)
  misc_feature (36): n=a or t
cttcaaagttcagttttacatccatctattcctttntaataaagattatgacagcttccaattcatttgct

SEQ ID NO: 49808 - DNA, 71 bp, chicken (Gallus Gallus)
  misc_feature (36): n=a or t
ataattatccatttttcatgtgagatggctacaatnaacaatctttcagtagatgaaatacttcttaaaga

SEQ ID NO: 49809 - DNA, 71 bp, chicken (Gallus Gallus)
  misc_feature (36): n=c or g
aaccgtcctgttaatgtttgtaagaaacttgacgtntcagtgtgcgaagacatacgattacaacttcgatc

SEQ ID NO: 49810 - DNA, 71 bp, chicken (Gallus Gallus)
  misc_feature (36): n=a or t
tttgaagacagctgctatcctttctcaatctgttangcaagtgatgtaatcacgaccagcatgataacaca

SEQ ID NO: 49811 - DNA, 71 bp, chicken (Gallus Gallus)
  misc_feature (36): n=c or g
catgccagcacccctaaaagagtcaaaccattttcntactccacctccctttatgtctaggatcctttagg

SEQ ID NO: 49812 - DNA, 71 bp, chicken (Gallus Gallus)
  misc_feature (36): n=c or g
tgttcccaccgttcttagataatcagaaatacagantggtgttgcatttgtcccatgctattcttaaattt

SEQ ID NO: 49813 - DNA, 71 bp, chicken (Gallus Gallus)
  misc_feature (36): n=c or g
tgaccttggatctaaaatgctctccttctgccaacnatttgcatcgtggatattgcttttgagtcaggaat

SEQ ID NO: 49814 - DNA, 71 bp, chicken (Gallus Gallus)
  misc_feature (36): n=c or g
aaagcatcctgcaggtgctgccggagtgacaaaggnacaggctacacatggtgaataagtgtgcatggaca

SEQ ID NO: 49815 - DNA, 71 bp, chicken (Gallus Gallus)
  misc_feature (36): n=a or t
gtatggatagacctttcactctaattttttttgctnccacacggtgctatcttttttttctattatgttct

SEQ ID NO: 49816 - DNA, 71 bp, chicken (Gallus Gallus)
  misc_feature (36): n=a or t
agattcagctgaacacaaaaagctttataagcattnctctctcttctggtaactaccacagaatggctctc

SEQ ID NO: 49817 - DNA, 71 bp, chicken (Gallus Gallus)
  misc_feature (36): n=c or g
gcttgcattcatctttgcatgttgagggaagagaanctcaaattactgactgaaagtggtagttgcctggg

SEQ ID NO: 49818 - DNA, 71 bp, chicken (Gallus Gallus)
  misc_feature (36): n=a or t
ggcaagtttcagatctactttgataactgccctctnctaactattccgggtcgcacccatcctgtggagat

SEQ ID NO: 49819 - DNA, 71 bp, chicken (Gallus Gallus)
  misc_feature (36): n=c or g
cagcggggggtccccacaggtccccgccggcccccncggttctgtaattagcgcagatgaagactgatggc

SEQ ID NO: 49820 - DNA, 71 bp, chicken (Gallus Gallus)
  misc_feature (36): n=c or g
aaggctctagaggagaatgtcctgcaggattataanaagccagtctactaaagatatcttcacagtaagcc

SEQ ID NO: 49821 - DNA, 71 bp, chicken (Gallus Gallus)
  misc_feature (36): n=a or t
cccaaaagctgagcgtctctcccagcatctctgctncccacagagagatcctctgccacaggagaaccagg

SEQ ID NO: 49822 - DNA, 71 bp, chicken (Gallus Gallus)
  misc_feature (36): n=a or t
atttgaatctagctgacttgatagttgaatgcttcntgacaaattccatttttcgtattgttgttgtttca

SEQ ID NO: 49823 - DNA, 71 bp, chicken (Gallus Gallus)
  misc_feature (36): n=a or t
cataccatcacatttttcctctatcctttgactatntaattgtttaaaactgaaggctttctagcagccca

SEQ ID NO: 49824 - DNA, 71 bp, chicken (Gallus Gallus)
  misc_feature (36): n=c or g
aggagtgacttgcagggaccattgcaagtctagtgnagataaaatgggttcaattctattgacaatattca

SEQ ID NO: 49825 - DNA, 71 bp, chicken (Gallus Gallus)
  misc_feature (36): n=a or t
accttttggagctttagacagtaattcctgaggggnacttgtgaaggatttgtggggtttttttgcctgtc

SEQ ID NO: 49826 - DNA, 71 bp, chicken (Gallus Gallus)
  misc_feature (36): n=a or t
gggatgctgagatgtttaggatcattaaatagggtnattaacattgctttgcaaaaatgattgaaagttca

SEQ ID NO: 49827 - DNA, 71 bp, chicken (Gallus Gallus)
  misc_feature (36): n=c or g
tatgtccattgttaataaacattgatgttcttcctnttttccactatttgcatgtcccataacaaaatttt

SEQ ID NO: 49828 - DNA, 71 bp, chicken (Gallus Gallus)
  misc_feature (36): n=c or g
acagtccagaaatcctaaatcacagattacaagganctggggaaataccagtaaggaatcatcatttctta

SEQ ID NO: 49829 - DNA, 71 bp, chicken (Gallus Gallus)
  misc_feature (36): n=a or t
actgccctaaggtttttcttccccaaatttattttngtgtgacacataataatcagtgcaatgatccatac

SEQ ID NO: 49830 - DNA, 71 bp, chicken (Gallus Gallus)
  misc_feature (36): n=a or t
ctatcgttttttttatgatttctcatggattattanttctgtaaaccgaactattacagactgcactaata

SEQ ID NO: 49831 - DNA, 71 bp, chicken (Gallus Gallus)
  misc_feature (36): n=c or g
ccaacggtaagagaacctaggcacaaggatgcagcnagggagcatccctgcagatgggctcctcctggaag

SEQ ID NO: 49832 - DNA, 71 bp, chicken (Gallus Gallus)
  misc_feature (36): n=a or t
atatgttctgaaaacctggcagaaggctgaatggtngtacggcatttgggggctttgtccttaaggctgct

SEQ ID NO: 49833 - DNA, 71 bp, chicken (Gallus Gallus)
  misc_feature (36): n=a or t
atgtaattcatctcatagaacttatacaatgtgaanaacatgtggactattgatgctattcagcgagcaaa

SEQ ID NO: 49834 - DNA, 71 bp, chicken (Gallus Gallus)
  misc_feature (36): n=c or g
agcttccttcccttcatggtcttacccgaaatgggncaagttgtgcagtgccttctttgatgtcaggaact

SEQ ID NO: 49835 - DNA, 71 bp, chicken (Gallus Gallus)
  misc_feature (36): n=a or t
aagaaatgtagctaacaaagatgcttgagaggtgtnttcttcagatacacacatggtgttcacttattaag

SEQ ID NO: 49836 - DNA, 71 bp, chicken (Gallus Gallus)
  misc_feature (36): n=a or t
gttcagcttagacaccgctattaactaggtggaggnttctctaaaaactcattgaatgtcttgaagagtga

SEQ ID NO: 49837 - DNA, 71 bp, chicken (Gallus Gallus)
  misc_feature (36): n=a or t
taagccacaagtccagaggaaaaggtctttaataantctatcgggtttcatgtggttccacagaattagat

SEQ ID NO: 49838 - DNA, 71 bp, chicken (Gallus Gallus)
  misc_feature (36): n=c or g
cacacaccccctttgcacgcccatacccttcacatnaacccactttcacaactctataccccatgagcaaa

SEQ ID NO: 49839 - DNA, 71 bp, chicken (Gallus Gallus)
  misc_feature (36): n=c or g
cagtcacacttggagcacgtaatgaagaactgacanccgttagtacttggaccactgtttgcctgcaggtt

SEQ ID NO: 49840 - DNA, 71 bp, chicken (Gallus Gallus)
  misc_feature (36): n=c or g
atgcatctagccttgaaaagtcagtaaagcactttnttcattctttcagtacgcacattcaacaggaaatg

SEQ ID NO: 49841 - DNA, 71 bp, chicken (Gallus Gallus)
  misc_feature (36): n=c or g
tcacatcatgaggttcttaagaaaatggcacaatantttctagattttgtttgttgttaattatgacttat

SEQ ID NO: 49842 - DNA, 71 bp, chicken (Gallus Gallus)
  misc_feature (36): n=a or t
ttaggtaagacagcattcccatgacagtaataatantttatatcttatattctcattaatgggtggtcctt

SEQ ID NO: 49843 - DNA, 71 bp, chicken (Gallus Gallus)
  misc_feature (36): n=a or t
attcctctccacgttgttttcttaacccatttattnccacagagaaataagacattttgaatgggaactgc

SEQ ID NO: 49844 - DNA, 71 bp, chicken (Gallus Gallus)
  misc_feature (36): n=c or g
tgctgccgctgcttttgtcaacacaacctactcttntctttggccaagaaccccttggggaactcactggt

SEQ ID NO: 49845 - DNA, 71 bp, chicken (Gallus Gallus)
  misc_feature (36): n=a or t
aaatatctactgtatatgactgctagtaagtatganacacattttcagaactgaaaatccatgcaacatat

SEQ ID NO: 49846 - DNA, 71 bp, chicken (Gallus Gallus)
  misc_feature (36): n=c or g
attctgctggtggtttttgcattagtgcatgccatnccttcaactttgtctttctgtctagtttatgaaga

SEQ ID NO: 49847 - DNA, 71 bp, chicken (Gallus Gallus)
  misc_feature (36): n=c or g
ttctttgaccttgcaaagtgaagatgaaggaaaatnctcccttcctacaaatgaatcaaaccaggttaatc

SEQ ID NO: 49848 - DNA, 71 bp, chicken (Gallus Gallus)
  misc_feature (36): n=c or g
catctttgagttccagtgagatcctgaggtcttgtnttgtgttgtgcagagagcacaacctactttctgga

SEQ ID NO: 49849 - DNA, 71 bp, chicken (Gallus Gallus)
  misc_feature (36): n=c or g
gctaaaaatgaagaaaatcctcactaaattgctttnaatgttcaaacagaccgagttccctttttcaactg

SEQ ID NO: 49850 - DNA, 71 bp, chicken (Gallus Gallus)
  misc_feature (36): n=c or g
ggctctaaagcagacttcagggaaaagctgaacaantttttagcaagggtgtttcagagcagaaattgttc

SEQ ID NO: 49851 - DNA, 71 bp, chicken (Gallus Gallus)
  misc_feature (36): n=c or g
ccatctctgtctttaggtaggtctttgagacagaanaacaacataacattaatttcagaaccagttctaca

SEQ ID NO: 49852 - DNA, 71 bp, chicken (Gallus Gallus)
  misc_feature (36): n=c or g
agatgattccatgcaaggcatcttcctttacctcancatctagtgaaatgggggttatgttgcatgttaga

SEQ ID NO: 49853 - DNA, 71 bp, chicken (Gallus Gallus)
  misc_feature (36): n=a or t
ccagattatgctgtgaaaaggaatctaagtaattcnaatgtagaaacgctgaatgtaacagacttgctttg

SEQ ID NO: 49854 - DNA, 71 bp, chicken (Gallus Gallus)
  misc_feature (36): n=c or g
aaacaggaaatctaatacataattcagcagctaatnatcataggtaatttacagagcgtttaatcattact

SEQ ID NO: 49855 - DNA, 71 bp, chicken (Gallus Gallus)
  misc_feature (36): n=c or g
gttcatcaaagccacagagagaagtctgtgtctgtnatctggcattcctgtactctctgcactataaaatc

SEQ ID NO: 49856 - DNA, 71 bp, chicken (Gallus Gallus)
  misc_feature (36): n=c or g
gttacctgttttatagcgcatcatccatcactcctnttaatctggcactttccagtagccttgaatggcaa

SEQ ID NO: 49857 - DNA, 71 bp, chicken (Gallus Gallus)
  misc_feature (36): n=a or t
acactgttttaacaacagcttcctaaattatctgcnttccaaactctgactaacttagccaagcttttggt

SEQ ID NO: 49858 - DNA, 71 bp, chicken (Gallus Gallus)
  misc_feature (36): n=c or g
cacttaatacaaggctttccttgcccaaggaggccntctgacagtatgctgctgcttttaaagcccctgtc

SEQ ID NO: 49859 - DNA, 71 bp, chicken (Gallus Gallus)
  misc_feature (36): n=c or g
gtcactataatgtaggactaggaaatcattatatcntcctacagtctctttctccagaagaagcagtatgc

SEQ ID NO: 49860 - DNA, 71 bp, chicken (Gallus Gallus)
  misc_feature (36): n=c or g
tgatgcaacggaagtaaccagcttgcagaatttccnttcttgcacaacacatttactaaacttaacaaggg

SEQ ID NO: 49861 - DNA, 71 bp, chicken (Gallus Gallus)
  misc_feature (36): n=c or g
taacaaaatggggatgctagaagttaaacacagcanaggaggtcaggtagctgttaatcacgttactaaac

SEQ ID NO: 49862 - DNA, 71 bp, chicken (Gallus Gallus)
  misc_feature (36): n=a or t
tttttccccctcaccaaagtattaggttaaatagangtttcaagaaggctgagaaataaccaattcctctt

SEQ ID NO: 49863 - DNA, 71 bp, chicken (Gallus Gallus)
  misc_feature (36): n=c or g
cgttaaggatgcctgtccagcggtcagattcctctncccttctggcacaagacttctgttacacaagctaa

SEQ ID NO: 49864 - DNA, 71 bp, chicken (Gallus Gallus)
  misc_feature (36): n=c or g
gggctaacggtggaaaccccttgttttagacaccangtatttattgcagcgattctctggttttgttacac

SEQ ID NO: 49865 - DNA, 71 bp, chicken (Gallus Gallus)
  misc_feature (36): n=c or g
aactgtcaggagatgttcaatttcagaggacttganaaatggtgggaatagttggggaaaaaagtataact

SEQ ID NO: 49866 - DNA, 71 bp, chicken (Gallus Gallus)
  misc_feature (36): n=c or g
ctttggccaggtacagagccagggacttccccatgnttctctatttgcgggcttcctcatgacctccacca

SEQ ID NO: 49867 - DNA, 71 bp, chicken (Gallus Gallus)
  misc_feature (36): n=a or t
gatccttttacctgaaatgttgttctgcatatagcncttgtctgaaatcagttgttcacatgctggagaag

SEQ ID NO: 49868 - DNA, 71 bp, chicken (Gallus Gallus)
  misc_feature (36): n=a or t
gatttcttgtgctgtcatgccgtggtctctgctgtncatcttgtttcaaactgtagtagcagcaggttttt

SEQ ID NO: 49869 - DNA, 71 bp, chicken (Gallus Gallus)
  misc_feature (36): n=a or t
tgccttctgttctgtgtccccacattgttttcccantttgctggttttccagggctataggagttggagtg

SEQ ID NO: 49870 - DNA, 71 bp, chicken (Gallus Gallus)
  misc_feature (36): n=a or t
tgagttcttagttgcagaaataactttttgatgttnatcataatttagcattattccacaaccctgtattt

SEQ ID NO: 49871 - DNA, 71 bp, chicken (Gallus Gallus)
  misc_feature (36): n=c or g
ctatggtaggtgtccatgtagccttgattgtggatntatttcttattaattaaaaagaggttgcttgctct

SEQ ID NO: 49872 - DNA, 71 bp, chicken (Gallus Gallus)
  misc_feature (36): n=a or t
ctgccctgaaaacctcctttaaaatgaacaagtgancaaacaaacaaaaccaattaccactaaaattcagt

SEQ ID NO: 49873 - DNA, 71 bp, chicken (Gallus Gallus)
  misc_feature (36): n=c or g
ctccctaaatgtgttatccagggatgtttatgtacnaaatatcttattccggaggtttacaaaaacaaaca

SEQ ID NO: 49874 - DNA, 71 bp, chicken (Gallus Gallus)
  misc_feature (36): n=c or g
actgtgattctcacagtagagctgaagatatacatnatccaatactgaggtggggtttattttccatggta

SEQ ID NO: 49875 - DNA, 71 bp, chicken (Gallus Gallus)
  misc_feature (36): n=c or g
attttagccttacaaacactgttatttaactattantattactttagcaatcttgcctgtgagaaaaacct

SEQ ID NO: 49876 - DNA, 71 bp, chicken (Gallus Gallus)
  misc_feature (36): n=c or g
gaaataacatactgtatttgcatgtgtaatggctgnttaggcataacagctgactttgacaaagggtgaca

SEQ ID NO: 49877 - DNA, 71 bp, chicken (Gallus Gallus)
  misc_feature (36): n=a or t
agccggtcttttatattaaggcatcgaccagtaccngaaatccctgaatcaagcaaagttgatacttcatc

SEQ ID NO: 49878 - DNA, 71 bp, chicken (Gallus Gallus)
  misc_feature (36): n=a or t
cactattggggtgctaatccctcttgagtcactatngacgtttgtaacttgatctttatgtcacatttttc

SEQ ID NO: 49879 - DNA, 71 bp, chicken (Gallus Gallus)
  misc_feature (36): n=c or g
aggggttagctttcactgagctgaggcaaagtattntataaaaaatgctggggcagaggattttagccagg

SEQ ID NO: 49880 - DNA, 71 bp, chicken (Gallus Gallus)
  misc_feature (36): n=c or g
ttactttgatgattttacttggcaactccttccatntgctcagtactagtactctttgagtgagatattgt

SEQ ID NO: 49881 - DNA, 71 bp, chicken (Gallus Gallus)
  misc_feature (36): n=a or t
cacaacttcctaaagttatctgtagttaccttcaanagtgaaggaagtgaactctttgtttcggtgaattg

SEQ ID NO: 49882 - DNA, 71 bp, chicken (Gallus Gallus)
  misc_feature (36): n=a or t
agcgtggatgtgttgaaaacatggagatcatggtangaaataaggaagggcatagagcaaacagaggattg

SEQ ID NO: 49883 - DNA, 71 bp, chicken (Gallus Gallus)
  misc_feature (36): n=a or t
tgaagacgttcacctcccccatcgctcgccttagcncactgcagcagcatctgggctgaaaaggtgtgggt

SEQ ID NO: 49884 - DNA, 71 bp, chicken (Gallus Gallus)
  misc_feature (36): n=a or t
aagcctcttggctagagcatccttttcatgagatancatgggcttgatgacacccccatggggacatggtg

SEQ ID NO: 49885 - DNA, 71 bp, chicken (Gallus Gallus)
  misc_feature (36): n=c or g
cctgctgatttcactcagagctgatagagcaacagnaatggttactggtttaccattctcttggtttccta

SEQ ID NO: 49886 - DNA, 71 bp, chicken (Gallus Gallus)
  misc_feature (36): n=c or g
aagaatgtttgacttcaggattagaaacctgaatcntcttccagtaatgaatacagtgactggtatgggcc

SEQ ID NO: 49887 - DNA, 71 bp, chicken (Gallus Gallus)
  misc_feature (36): n=a or t
actaatggaaatttgtacagtatacactaaatcatntgggagtaaaagtgagtaatagtaactcattaaaa

SEQ ID NO: 49888 - DNA, 71 bp, chicken (Gallus Gallus)
  misc_feature (36): n=a or t
ccttaggcttagacatcagcaacctcatgaaaagcntattggaaatcttccttacactgccctagatgtgt

SEQ ID NO: 49889 - DNA, 71 bp, chicken (Gallus Gallus)
  misc_feature (36): n=a or t
aacgggccctggggaattatcagcctcctgctcttnttcttttctccagtaatccaagcatctaaccgtca

SEQ ID NO: 49890 - DNA, 71 bp, chicken (Gallus Gallus)
  misc_feature (36): n=c or g
gcacagagcaatacaggctaattgactatggcaacnagctagatgaatgaggattactcttgggagcacat

SEQ ID NO: 49891 - DNA, 71 bp, chicken (Gallus Gallus)
  misc_feature (36): n=c or g
aagttaagtatggtgatttatgtcaaagccacattntcaaagttgtttcatttctaggtggataataatgt

SEQ ID NO: 49892 - DNA, 71 bp, chicken (Gallus Gallus)
  misc_feature (36): n=c or g
gctgagcgtgatgcttcattactcagaaacaggtgntcctaatcctccaattatatgcttgttacagattt

SEQ ID NO: 49893 - DNA, 71 bp, chicken (Gallus Gallus)
  misc_feature (36): n=a or t
tcctactcttcttttacctcccaagctctttctcantttcatctccatttcagtactctgttgtcctcatt

SEQ ID NO: 49894 - DNA, 71 bp, chicken (Gallus Gallus)
  misc_feature (36): n=c or g
atttttaaatctgttatttcctccattgagcagaangtacctgagagacctctcatgctgttatttttgta

SEQ ID NO: 49895 - DNA, 71 bp, chicken (Gallus Gallus)
  misc_feature (36): n=c or g
atacactgaaactacacttggagctacaaatgaagnccaactgaaatttctgtcaacacacaggtgtcggg

SEQ ID NO: 49896 - DNA, 71 bp, chicken (Gallus Gallus)
  misc_feature (36): n=a or t
tatgaggccacttgtttcaagacataaatttgaggngaaatagtataaacagttaagccaataagtgggtt

SEQ ID NO: 49897 - DNA, 71 bp, chicken (Gallus Gallus)
  misc_feature (36): n=a or t
ctttagggctaaaaccctcaggttcttgtacactgngtttttcagcctcctgaccattacagtggcttatt

SEQ ID NO: 49898 - DNA, 71 bp, chicken (Gallus Gallus)
  misc_feature (36): n=c or g
ccagatggtacttccactttccctcaagctcctatncatgccctgaccagcacagagggtgagtctctcca

SEQ ID NO: 49899 - DNA, 71 bp, chicken (Gallus Gallus)
  misc_feature (36): n=c or g
ccggtgggattcttctgagctcgtttagccctcctncatgcagccctgcagggtgtgggatcagagccttc

SEQ ID NO: 49900 - DNA, 71 bp, chicken (Gallus Gallus)
  misc_feature (36): n=c or g
cctgagtgcctgcacttcacaggagccggcagctgnactctggcccttgtgcttgtgcagaagaagggcca

SEQ ID NO: 49901 - DNA, 71 bp, chicken (Gallus Gallus)
  misc_feature (36): n=c or g
gaaaacagaattctaatgttcacagttttagtgttntgtactgctttatatttgcaattaatttcacctag

SEQ ID NO: 49902 - DNA, 71 bp, chicken (Gallus Gallus)
  misc_feature (36): n=a or t
gaactgaaatgagattgttctcttttgttcccctcnaaatgacagtgatcagtccacgtggctcagaagca

SEQ ID NO: 49903 - DNA, 71 bp, chicken (Gallus Gallus)
  misc_feature (36): n=c or g
tctgccagtctggtctgcttgcagaattaagttcgntgttgctcagggtttgcttttagcacactgatgca

SEQ ID NO: 49904 - DNA, 71 bp, chicken (Gallus Gallus)
  misc_feature (36): n=a or t
ctttcttcatcctgcctcaaaaacaatatccttgcnattgaacttttggtaaaagtcaagggcacagcttt

SEQ ID NO: 49905 - DNA, 71 bp, chicken (Gallus Gallus)
  misc_feature (36): n=c or g
gtaattaccctttatcaggaacttttatagttcctnaattctttacgcaagttctgagatgttctccacct

SEQ ID NO: 49906 - DNA, 71 bp, chicken (Gallus Gallus)
  misc_feature (36): n=a or t
gagctgatggtgaaacagtgcacactgagcctcgangctctgcttaaccgataaacagcttagcaaattac

SEQ ID NO: 49907 - DNA, 71 bp, chicken (Gallus Gallus)
  misc_feature (36): n=c or g
taccaagtaggcttataaaaatggaaagtaatgcancaatgcacagtagcagcacggtgaaccaaatggtt

SEQ ID NO: 49908 - DNA, 71 bp, chicken (Gallus Gallus)
  misc_feature (36): n=c or g
agcccctaaaaatgtcgttttcacacagtaaatccnctgcacttgaatgtctgctggctttctgaaaggaa

SEQ ID NO: 49909 - DNA, 71 bp, chicken (Gallus Gallus)
  misc_feature (36): n=c or g
ttccattcacaggatttttagctccacctaacggtnagaaaggagacgattttcctgtctgcctcatgttt

SEQ ID NO: 49910 - DNA, 71 bp, chicken (Gallus Gallus)
  misc_feature (36): n=a or t
gtcaaataatgaattaaaagttgaaactaacagtgnacaggctatacgtgtcgtgagaagcatttgtcaaa

SEQ ID NO: 49911 - DNA, 71 bp, chicken (Gallus Gallus)
  misc_feature (36): n=a or t
aaagaggggaagtctgagacgcaaagaacaaatganctgccagcaactataaaagagcaagttaatagtag

SEQ ID NO: 49912 - DNA, 71 bp, chicken (Gallus Gallus)
  misc_feature (36): n=a or t
ttttaggttgcactctgaatctttgttgaaaccttncaaccattcccttctttcagagaatttcaacttca

SEQ ID NO: 49913 - DNA, 71 bp, chicken (Gallus Gallus)
  misc_feature (36): n=a or t
gtgtattgtaaaattctcttaacccagaaaacatcngtgcaaatcaaaactcttttctcattatttataaa

SEQ ID NO: 49914 - DNA, 71 bp, chicken (Gallus Gallus)
  misc_feature (36): n=c or g
caaggaagaatctgcacacagcaagaataagttagngagtgttgttctaattacaatatagaagtaattat

SEQ ID NO: 49915 - DNA, 71 bp, chicken (Gallus Gallus)
  misc_feature (36): n=a or t
gctctagtcagcggtgaggtgcttattgcttcgcangtgtgtgtgcttttatgctgagcaaacctattagg

SEQ ID NO: 49916 - DNA, 71 bp, chicken (Gallus Gallus)
  misc_feature (36): n=a or t
gttattttttattttgtttgaaagagtgtcctgaanaggttgagatgtgacatgttgtggttcttgagcta

SEQ ID NO: 49917 - DNA, 71 bp, chicken (Gallus Gallus)
  misc_feature (36): n=c or g
agaactgctaggacagtgtcacttgaaagacaattnagcctgcatgggaagccagcttgagaacagggtga

SEQ ID NO: 49918 - DNA, 71 bp, chicken (Gallus Gallus)
  misc_feature (36): n=a or t
aaaaagcagtaaggcagtcaaaggaactgacattantatgaagtaactgtgagggaatggaagaacattcc

SEQ ID NO: 49919 - DNA, 71 bp, chicken (Gallus Gallus)
  misc_feature (36): n=a or t
aaagaaaaataaaatgagactctcagttactgtttntgtgttaaatacagttactgggtgcttttataata

SEQ ID NO: 49920 - DNA, 71 bp, chicken (Gallus Gallus)
  misc_feature (36): n=a or t
cgtggaaaactataactgatattgtgcttaacggtnccgcctttgtaactttggaaattggaaaggaactc

SEQ ID NO: 49921 - DNA, 71 bp, chicken (Gallus Gallus)
  misc_feature (36): n=a or t
tttcttttaaagaacagtcagcttccttttgttacngctgtgaagtacttttcccaactaactccaagtcg

SEQ ID NO: 49922 - DNA, 71 bp, chicken (Gallus Gallus)
  misc_feature (36): n=a or t
gtaaaaaaagaggaaggaattctgttatgcaattanaacccaggagagcagtctaggattgtagtcacaga

SEQ ID NO: 49923 - DNA, 71 bp, chicken (Gallus Gallus)
  misc_feature (36): n=a or t
aacatctgcgctttatactttcaaaacttacaagantcaatactacatgtgcgagtatcgattgtagaaac

SEQ ID NO: 49924 - DNA, 71 bp, chicken (Gallus Gallus)
  misc_feature (36): n=c or g
tatacctgggtatggtactgtggtggctgaattaantactggaacacaggatgtgtctgatacacagaaag

SEQ ID NO: 49925 - DNA, 71 bp, chicken (Gallus Gallus)
  misc_feature (36): n=c or g
gctagtgtcacttaaatctgtgtaccaaatactgcncccaagttagtggtcatcagctggcatgaggcagc

SEQ ID NO: 49926 - DNA, 71 bp, chicken (Gallus Gallus)
  misc_feature (36): n=a or t
ttaacttttgacttaactttgataacttaagtttgncatacttttagacaacctcaggaatagcagagcta

SEQ ID NO: 49927 - DNA, 71 bp, chicken (Gallus Gallus)
  misc_feature (36): n=c or g
acagttgtagcacagaacctgatttgtgctccctgncagggttttctgtcactttattatcatttagaaag

SEQ ID NO: 49928 - DNA, 71 bp, chicken (Gallus Gallus)
  misc_feature (36): n=c or g
gtggaagtactctagaccttagtgattattagggantacatgtttttcactgaaacatgtgctctcttgcc

SEQ ID NO: 49929 - DNA, 71 bp, chicken (Gallus Gallus)
  misc_feature (36): n=c or g
gagaagctcaattgacctgtggtcctagctgatccncactagttgtgaaggcaattgcagagaaaaaaaaa

SEQ ID NO: 49930 - DNA, 71 bp, chicken (Gallus Gallus)
  misc_feature (36): n=a or t
acatggattttgtaggtgctgaccaaggctgtaccngtgggagctagcagggaagtgtctgagagttgggg

SEQ ID NO: 49931 - DNA, 71 bp, chicken (Gallus Gallus)
  misc_feature (36): n=c or g
gcctcacactttgaagagatggtgagccttcaccanaaattgaagtggatactaaactgagtctgcagagc

SEQ ID NO: 49932 - DNA, 71 bp, chicken (Gallus Gallus)
  misc_feature (36): n=c or g
taggtatctcaggctctcagcatgctgttctgtcangcatgatgctatctcgcaatccttccgctacgaag

SEQ ID NO: 49933 - DNA, 71 bp, chicken (Gallus Gallus)
  misc_feature (36): n=c or g
gagccaggctgctgtgaagctgtggacccccagatnatgacttgtgttaggaggtaggacagcaggacagg

SEQ ID NO: 49934 - DNA, 71 bp, chicken (Gallus Gallus)
  misc_feature (36): n=c or g
taggttgacattttcaaattggaaagaagtggctgntgctgggctgctatcacgtgcctctgcgacactaa

SEQ ID NO: 49935 - DNA, 71 bp, chicken (Gallus Gallus)
  misc_feature (36): n=a or t
gccgggccgatatctgtcgatttatcacttaaatanttcacgcgtgttttgaggaaacgctccgattcgtc

SEQ ID NO: 49936 - DNA, 71 bp, chicken (Gallus Gallus)
  misc_feature (36): n=c or g
aaacagctgtgctggtggggacatgggaaggcatgnaagtcttcaagcagatgctctaactcaaactactt

SEQ ID NO: 49937 - DNA, 71 bp, chicken (Gallus Gallus)
  misc_feature (36): n=a or t
caacgtctgtgagaaaactgaagagattattgcacngtggcgtgggctagacacagactggggtttctgga

SEQ ID NO: 49938 - DNA, 71 bp, chicken (Gallus Gallus)
  misc_feature (36): n=a or t
tgatatgccacgattgagcgacaaatgtcgtctttntattgaaatgataggttgtgaattaatccatatgt

SEQ ID NO: 49939 - DNA, 71 bp, chicken (Gallus Gallus)
  misc_feature (36): n=c or g
gtcaacagagagtatgggcagggcaatgacgtggantctttctctttaggacgtaacagaagatgatgatg

SEQ ID NO: 49940 - DNA, 71 bp, chicken (Gallus Gallus)
  misc_feature (36): n=a or t
tctgtgaatcaattcacttgtgtgtgcaggcgtagnagttgttactggatcacacacaatgttcatagtta

SEQ ID NO: 49941 - DNA, 71 bp, chicken (Gallus Gallus)
  misc_feature (36): n=c or g
cacggtctacagaagcacattacaagttctgagtgntaaagttctaacaggaaaggacagaggggaagtgt

SEQ ID NO: 49942 - DNA, 71 bp, chicken (Gallus Gallus)
  misc_feature (36): n=c or g
cagtgatgtgcccagtgtgcacattaattgtctctntctcttcagattatcactccatgtcggaagctcat

SEQ ID NO: 49943 - DNA, 71 bp, chicken (Gallus Gallus)
  misc_feature (36): n=c or g
tgtctttccgtgttctgagaagacataaggcatgantgtagtttatcagctaatcagctggcaggaatctt

SEQ ID NO: 49944 - DNA, 71 bp, chicken (Gallus Gallus)
  misc_feature (36): n=c or g
ataagtggtgtttttattgtatttctgataactgtntctcttttcctaaagacactatgtattctctctgc

SEQ ID NO: 49945 - DNA, 71 bp, chicken (Gallus Gallus)
  misc_feature (36): n=c or g
acatgcaaccccagaaacactaacgccttgcccatntctggctgtgctgggggaaaggcacagtgacatgc

SEQ ID NO: 49946 - DNA, 71 bp, chicken (Gallus Gallus)
  misc_feature (36): n=a or t
gaaacatcctgctatctgctgagttatatcagcgcncttaaggacactttggacaatttgcaatcctgaat

SEQ ID NO: 49947 - DNA, 71 bp, chicken (Gallus Gallus)
  misc_feature (36): n=c or g
tatatcctgcctgaatgtcctacacataaccagttntgcctttttgcatggtagcaagaacacatgtaact

SEQ ID NO: 49948 - DNA, 71 bp, chicken (Gallus Gallus)
  misc_feature (36): n=c or g
tatgaaatctgtatcagtatgaaactctctccaacnctaaaaaatagtggaagatgctaccccaggaaaag

SEQ ID NO: 49949 - DNA, 71 bp, chicken (Gallus Gallus)
  misc_feature (36): n=a or t
gggcccctccatttgtctagtagagttacagaatcnatttgtgactttactgactgtagaaggggagtaac

SEQ ID NO: 49950 - DNA, 71 bp, chicken (Gallus Gallus)
  misc_feature (36): n=a or t
ccaatgcctgtatcatggaaaaatccccaaactagnagaaactcgtatcttttgagccatatggtgttata

SEQ ID NO: 49951 - DNA, 71 bp, chicken (Gallus Gallus)
  misc_feature (36): n=a or t
atataattacttgtctaactttcttttattgagctntgaaaagtagttaatttttagtgtcagttagatag

SEQ ID NO: 49952 - DNA, 71 bp, chicken (Gallus Gallus)
  misc_feature (36): n=c or g
aactcgtgcaaggcactgagctaaggatgaggaaancacccagtctgtactgcactgtgatgctacgggca

SEQ ID NO: 49953 - DNA, 71 bp, chicken (Gallus Gallus)
  misc_feature (36): n=c or g
gagtaccacatttctatttctttcaggtgactgggnagctcaggattgaagattattattacgccatgaga

SEQ ID NO: 49954 - DNA, 71 bp, chicken (Gallus Gallus)
  misc_feature (36): n=c or g
tgcttcctgaaagaagcgccagcccccccagctcanacgaaaccttgtgctgaagtcagtgatgctcacag

SEQ ID NO: 49955 - DNA, 71 bp, chicken (Gallus Gallus)
  misc_feature (36): n=a or t
aaaaactgtttgctactttttgctctttttaccttnaccaagcattgagctctgaccaatcattcccaagc

SEQ ID NO: 49956 - DNA, 71 bp, chicken (Gallus Gallus)
  misc_feature (36): n=a or t
cttgttttagagaagaacatgaactatcatctcttnaaattgaatttttccaaaatgttggtccagtttga

SEQ ID NO: 49957 - DNA, 71 bp, chicken (Gallus Gallus)
  misc_feature (36): n=c or g
aactgtgctgaaggatctcagctgtatgagtcacanaggagctgatctttcactgctctctctttgtagat

SEQ ID NO: 49958 - DNA, 71 bp, chicken (Gallus Gallus)
  misc_feature (36): n=a or t
tgagtctactactattggcataggcattctccttanaacgaatttacaagaaatctgtcttcaaatttgtt

SEQ ID NO: 49959 - DNA, 71 bp, chicken (Gallus Gallus)
  misc_feature (36): n=a or t
tgtccgcagccttgaactcaggcgaccaaacttaantgtacaacacaacacactgctggagtggtgcagca

SEQ ID NO: 49960 - DNA, 71 bp, chicken (Gallus Gallus)
  misc_feature (36): n=a or t
cactattccagcaatttcactggaaaggttacatcntgtagtactgcatagcatgaaaagattttgtacaa

SEQ ID NO: 49961 - DNA, 71 bp, chicken (Gallus Gallus)
  misc_feature (36): n=a or t
catttatttaagaaaaccattcagatgtaattcacncccacttgtcaaattcttacatgcaatggagatat

SEQ ID NO: 49962 - DNA, 71 bp, chicken (Gallus Gallus)
  misc_feature (36): n=c or g
atacctacctgccctgaaatggtgttatcacatacngtattttaatatgatacgaatcttgtgggttgttg

SEQ ID NO: 49963 - DNA, 71 bp, chicken (Gallus Gallus)
  misc_feature (36): n=a or t
tatgaacttggtggcactttgtgttaattctaaggncaggtccatggaatgtccagcaaggtagtgggaat

SEQ ID NO: 49964 - DNA, 71 bp, chicken (Gallus Gallus)
  misc_feature (36): n=c or g
ctgactctggctgccagagctttaatggggtttcanagatccaagcctaccatagttgtattcctgaagtg

SEQ ID NO: 49965 - DNA, 71 bp, chicken (Gallus Gallus)
  misc_feature (36): n=c or g
gagcttaactttgatttctattccatcagaaagagnaatacaattcatctaatactgtactgaagtattgg

SEQ ID NO: 49966 - DNA, 71 bp, chicken (Gallus Gallus)
  misc_feature (36): n=c or g
gtgcattaaacatgtaggaaagtgttgcttacatgntgtgatgttttttgtcttaatttaccctttaaaga

SEQ ID NO: 49967 - DNA, 71 bp, chicken (Gallus Gallus)
  misc_feature (36): n=a or t
gaccactgaaaaatcttcacaatttttagtttcacngttctgaatttcttcattcttaaccttcgctctat

SEQ ID NO: 49968 - DNA, 71 bp, chicken (Gallus Gallus)
  misc_feature (36): n=a or t
taacgtaaacaatattctgtctgttttttgtgttcntcaggatagtctcatgatcaccacttacatggatt

SEQ ID NO: 49969 - DNA, 71 bp, chicken (Gallus Gallus)
  misc_feature (36): n=c or g
catgctgaaaatcagaatcccttatttagtcaggtntcttctattttatgtcactgaggctttgcagatag

SEQ ID NO: 49970 - DNA, 71 bp, chicken (Gallus Gallus)
  misc_feature (36): n=c or g
accagcttatgaatcagccatcacagactgcatttncaggtgtaacattacaggccataagctgcctttat

SEQ ID NO: 49971 - DNA, 71 bp, chicken (Gallus Gallus)
  misc_feature (36): n=c or g
gttttgagtgtaaatagtggctttctgagagtgcangtctcttctgtgccctaggctgctgctgcttccct

SEQ ID NO: 49972 - DNA, 71 bp, chicken (Gallus Gallus)
  misc_feature (36): n=a or t
gcataaagtatgtgaaacaagtagggaattacaaanaataaggatcaatgccttttctacatgcagtgact

SEQ ID NO: 49973 - DNA, 71 bp, chicken (Gallus Gallus)
  misc_feature (36): n=a or t
tactacgtttacttattgccatgattcattcaaccncattacattttactgaatgttcagaacagcttctc

SEQ ID NO: 49974 - DNA, 71 bp, chicken (Gallus Gallus)
  misc_feature (36): n=c or g
ccctgttgtgctgtagccctatctccattaaaaaanttgggtttggtgttttaaaagtcaccttctctctg

SEQ ID NO: 49975 - DNA, 71 bp, chicken (Gallus Gallus)
  misc_feature (36): n=c or g
gtaagacatctgacccagaactcacagaattttgtncctggatagtttatttcagtcaataaaaatagcat

SEQ ID NO: 49976 - DNA, 71 bp, chicken (Gallus Gallus)
  misc_feature (36): n=c or g
cctcagttttcctaaataagggtaaggaagcagtgntgtgtgtcactgtgttggggagcatctctgccccc

SEQ ID NO: 49977 - DNA, 71 bp, chicken (Gallus Gallus)
  misc_feature (36): n=a or t
atgctttcattctacaggaaagaggatggcaggtanaattcatttaaatctccatttcttatctgtaaaag

SEQ ID NO: 49978 - DNA, 71 bp, chicken (Gallus Gallus)
  misc_feature (36): n=c or g
agctacacaaaatggtgggaaagtaaactgagtcanaagataagactgggaaaacaaagcctcctgattag

SEQ ID NO: 49979 - DNA, 71 bp, chicken (Gallus Gallus)
  misc_feature (36): n=c or g
gggtccaggctttgtgggaagggggttgagctcctnctggggtggggttcattttgctgcgctttgctgtg

SEQ ID NO: 49980 - DNA, 71 bp, chicken (Gallus Gallus)
  misc_feature (36): n=c or g
ccatgcggaggctgatgagctccaaggagtggcccncgaccagagtgggtgagcgtcgcccggcgggcacg

SEQ ID NO: 49981 - DNA, 71 bp, chicken (Gallus Gallus)
  misc_feature (36): n=c or g
ttcctgttacaagcttttctttcaactcccagtctncaatgtatctccagaccactactgtgttccacact

SEQ ID NO: 49982 - DNA, 71 bp, chicken (Gallus Gallus)
  misc_feature (36): n=c or g
tgtacattagtttccagctaagagtattacgattantgattaaaaaacacatgatacgggaaactcagttc

SEQ ID NO: 49983 - DNA, 71 bp, chicken (Gallus Gallus)
  misc_feature (36): n=a or t
ctgctgtttaactcttgggatttttctctctgcagnatctcagtgcaacagggaaggaaatgtgattgtaa

SEQ ID NO: 49984 - DNA, 71 bp, chicken (Gallus Gallus)
  misc_feature (36): n=a or t
actctctgtactcttgttggtacaagagctttttcngtagcaaacaagatttctgaaccaccagaccaaag

SEQ ID NO: 49985 - DNA, 71 bp, chicken (Gallus Gallus)
  misc_feature (36): n=c or g
aaactgttacacacatggtagcaatttctgttcttngtatacaaataccccaaaccatatgtaacgaaaac

SEQ ID NO: 49986 - DNA, 71 bp, chicken (Gallus Gallus)
  misc_feature (36): n=c or g
ctaagctgtgttgctattctttggtccatttgttangtaggagtatgtgccctataaatcccatttatgct

SEQ ID NO: 49987 - DNA, 71 bp, chicken (Gallus Gallus)
  misc_feature (36): n=a or t
tagctaaagcacaaagtaggatgtgaaattcctgtntataagaaaaaaaatgatgaaaaagaaattgttaa

SEQ ID NO: 49988 - DNA, 71 bp, chicken (Gallus Gallus)
  misc_feature (36): n=c or g
tacagctctgcttttacacccccaaagtgctccgcngcgctggtaaaacccaccatgtttattttcctaca

SEQ ID NO: 49989 - DNA, 71 bp, chicken (Gallus Gallus)
  misc_feature (36): n=c or g
atagaagaaaagcagttagaattgttgtctggatcntacacattttttcaatggctgggttggttttattg

SEQ ID NO: 49990 - DNA, 71 bp, chicken (Gallus Gallus)
  misc_feature (36): n=c or g
tcactgcagaatttgagtgtcatatcctcagacacntccctcctttcgagctggaaatgctgtctgagcag

SEQ ID NO: 49991 - DNA, 71 bp, chicken (Gallus Gallus)
  misc_feature (36): n=c or g
tggtctaactctacagataaagttcaatgtaaatgntgacatgctcaattttgacaacttaacaacaaaaa

SEQ ID NO: 49992 - DNA, 71 bp, chicken (Gallus Gallus)
  misc_feature (36): n=a or t
ccccaaactcttagtaaaagctgcagcaatcttgcntacaatcttatgtagcatttatcaatcagtgagta

SEQ ID NO: 49993 - DNA, 71 bp, chicken (Gallus Gallus)
  misc_feature (36): n=a or t
tactacgctttttatttttagatatgtgaaatacanctattaattttacattgaatcataatggtagtgag

SEQ ID NO: 49994 - DNA, 71 bp, chicken (Gallus Gallus)
  misc_feature (36): n=a or t
atttactggaaaaagattgtttataatactggcacnttctcaaagctaaacaacagagaagtcactggcca

SEQ ID NO: 49995 - DNA, 71 bp, chicken (Gallus Gallus)
  misc_feature (36): n=c or g
gtctggaaaaaatgacagagtccacagcttctgaangggtaggcaaggctccaaaagatccactggaaagt

SEQ ID NO: 49996 - DNA, 71 bp, chicken (Gallus Gallus)
  misc_feature (36): n=c or g
taaaatgcagaagaggtttggtttttcctctactcntgcagcatgttgattacaccaagtgtcttggtgtt

SEQ ID NO: 49997 - DNA, 71 bp, chicken (Gallus Gallus)
  misc_feature (36): n=a or t
gtgtcacccattcctcttagcaaagagggaaaaaantgaaatcctggagcaagatacgctgtagattaatg

SEQ ID NO: 49998 - DNA, 71 bp, chicken (Gallus Gallus)
  misc_feature (36): n=a or t
aaacttgttacaaacttcatcactggtggttaatgnctctggcaaggtgtgaacacctactgcctaatatc

SEQ ID NO: 49999 - DNA, 71 bp, chicken (Gallus Gallus)
  misc_feature (36): n=c or g
ctgcactgatgtacagatatagcgggaggaaagagntagggccaatcctgctgacaccctctaagccagcg

SEQ ID NO: 50000 - DNA, 71 bp, chicken (Gallus Gallus)
  misc_feature (36): n=c or g
actggtcacctcctgttctccttgtggttattcaanactaattaatttcagcaatattgcaagattagttt
